(12) United States Patent
Bernett et al.

(10) Patent No.: US 10,501,543 B2
(45) Date of Patent: Dec. 10, 2019

(54) IL15/IL15Rα HETERODIMERIC FC-FUSION PROTEINS

(71) Applicant: Xencor, Inc., Monrovia, CA (US)

(72) Inventors: Matthew Bernett, Monrovia, CA (US); Rumana Rashid, Azusa, CA (US); John Desjarlais, Pasadena, CA (US); Rajat Varma, Monrovia, CA (US); Christine Bonzon, Los Angeles, CA (US)

(73) Assignee: Xencor, Inc., Monrovia, CA (US)

( * ) Notice: Subject to any disclaimer, the term of this patent is extended or adjusted under 35 U.S.C. 154(b) by 87 days.

(21) Appl. No.: 15/785,401

(22) Filed: Oct. 16, 2017

(65) Prior Publication Data

US 2018/0118805 A1    May 3, 2018

Related U.S. Application Data

(60) Provisional application No. 62/408,655, filed on Oct. 14, 2016, provisional application No. 62/443,465, filed on Jan. 6, 2017, provisional application No. 62/477,926, filed on Mar. 28, 2017, provisional application No. 62/416,087, filed on Nov. 1, 2016.

(51) Int. Cl.
| | |
|---|---|
| *C07K 14/715* | (2006.01) |
| *C07K 14/54* | (2006.01) |
| *C12N 15/63* | (2006.01) |
| *A61P 35/00* | (2006.01) |
| *C07K 16/28* | (2006.01) |
| *A61K 38/00* | (2006.01) |
| *A61K 39/00* | (2006.01) |

(52) U.S. Cl.
CPC .......... *C07K 16/2818* (2013.01); *A61P 35/00* (2018.01); *C07K 14/5443* (2013.01); *C07K 14/7155* (2013.01); *C12N 15/63* (2013.01); *A61K 38/00* (2013.01); *A61K 2039/505* (2013.01); *C07K 2317/24* (2013.01); *C07K 2317/31* (2013.01); *C07K 2317/35* (2013.01); *C07K 2317/524* (2013.01); *C07K 2317/526* (2013.01); *C07K 2317/53* (2013.01); *C07K 2317/55* (2013.01); *C07K 2317/565* (2013.01); *C07K 2317/622* (2013.01); *C07K 2317/73* (2013.01); *C07K 2317/74* (2013.01); *C07K 2317/92* (2013.01); *C07K 2317/94* (2013.01); *C07K 2319/30* (2013.01); *C07K 2319/32* (2013.01)

(58) Field of Classification Search
None
See application file for complete search history.

(56) References Cited

U.S. PATENT DOCUMENTS

| | | |
|---|---|---|
| 3,773,919 A | 11/1973 | Boswell et al. |
| 4,169,888 A | 10/1979 | Hanka et al. |
| 4,179,337 A | 12/1979 | Davis et al. |
| 4,256,746 A | 3/1981 | Miyashita et al. |
| 4,294,757 A | 10/1981 | Asai |
| 4,301,144 A | 11/1981 | Iwashita et al. |
| 4,307,016 A | 12/1981 | Asai et al. |
| 4,313,946 A | 2/1982 | Powell et al. |
| 4,315,929 A | 2/1982 | Freedman et al. |
| 4,322,348 A | 3/1982 | Asai et al. |
| 4,331,598 A | 5/1982 | Hasegawa et al. |
| 4,361,650 A | 5/1982 | Asai et al. |
| 4,362,663 A | 12/1982 | Kida et al. |
| 4,364,866 A | 12/1982 | Asai et al. |
| 4,364,935 A | 12/1982 | Kung et al. |
| 4,371,533 A | 2/1983 | Akimoto et al. |
| 4,424,219 A | 1/1984 | Hashimoto et al. |
| 4,450,254 A | 5/1984 | Isley et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 4,880,935 A | 11/1989 | Thorpe |
| 4,923,990 A | 5/1990 | Nakano et al. |
| 4,943,533 A | 7/1990 | Mendelsohn et al. |
| 4,970,198 A | 11/1990 | Lee et al. |
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |
| 5,475,092 A | 12/1995 | Chari et al. |
| 5,500,362 A | 3/1996 | Robinson et al. |
| 5,530,101 A | 6/1996 | Queen et al. |
| 5,541,087 A | 7/1996 | Lo et al. |

(Continued)

FOREIGN PATENT DOCUMENTS

| | | |
|---|---|---|
| EP | 0425235 B1 | 9/1996 |
| EP | 0927254 | 6/2005 |

(Continued)

OTHER PUBLICATIONS

U.S. Appl. No. 12/631,508, filed Dec. 4, 2009, Chari et al.

(Continued)

*Primary Examiner* — Bridget E Bunner
(74) *Attorney, Agent, or Firm* — Robin M. Silva; Jennifer K. Ng; Morgan, Lewis & Bockius LLP

(57) ABSTRACT

The present invention is directed to novel IL15/IL15Rα heterodimeric Fc fusion proteins.

6 Claims, 259 Drawing Sheets

Specification includes a Sequence Listing.

(56) References Cited

U.S. PATENT DOCUMENTS

| | | |
|---|---|---|
| 5,550,246 A | 8/1996 | Nicolaou et al. |
| 5,558,864 A | 9/1996 | Bendig et al. |
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 1/2003 | Mateo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | MacK et al. |
| 6,737,056 B1 | 5/2004 | Presta |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,276,585 B2 | 10/2007 | Lazar et al. |
| 7,303,749 B1 | 12/2007 | Chari |
| 7,355,008 B2 | 4/2008 | Stavenhagen et al. |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,632,497 B2 | 12/2009 | Stavenhagen |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 7,834,152 B2 | 11/2010 | Strom et al. |
| 7,858,081 B2 | 12/2010 | Bernard et al. |
| 7,960,512 B2 | 6/2011 | Stavenhagen et al. |
| 8,003,774 B2 | 8/2011 | Stavenhagen et al. |
| 8,063,187 B2 | 11/2011 | Chu et al. |
| 8,114,967 B2 | 2/2012 | Bhatt et al. |
| 8,124,084 B2 | 2/2012 | LeFrancois et al. |
| 8,192,737 B2 | 6/2012 | Stavenhagen et al. |
| 8,216,574 B2 | 7/2012 | Stavenhagen |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,629,245 B2 | 1/2014 | Georgiou et al. |
| 8,637,641 B2 | 1/2014 | Dahiyat et al. |
| 8,679,493 B2 | 3/2014 | Georgiou et al. |
| 8,742,074 B2 | 6/2014 | Behrens et al. |
| 8,871,912 B2 | 10/2014 | Davis et al. |
| 8,940,288 B2 | 1/2015 | LeFrancois et al. |
| 8,940,289 B2 | 1/2015 | Wong et al. |
| 8,946,387 B2 | 2/2015 | Koenig et al. |
| 8,951,517 B2 | 2/2015 | Stavenhagen et al. |
| 9,028,815 B2 | 5/2015 | Stavenhagen et al. |
| 9,150,663 B2 | 10/2015 | Labrijn et al. |
| 9,308,258 B2 | 4/2016 | Kannan et al. |
| RE45,992 E | 5/2016 | Behrens et al. |
| 9,365,630 B2 | 6/2016 | LeFrancois et al. |
| 9,371,368 B2 | 6/2016 | LeFrancois et al. |
| 9,464,127 B2 | 10/2016 | Wong et al. |
| 9,493,533 B2 | 11/2016 | Bernard et al. |
| 9,505,848 B2 | 11/2016 | Davis et al. |
| 9,527,926 B2 | 12/2016 | Ho et al. |
| 9,562,109 B2 | 2/2017 | Von Kreudenstein et al. |
| 9,683,052 B2 | 6/2017 | Blein et al. |
| 9,683,053 B2 | 6/2017 | Blein et al. |
| 9,763,705 B2 | 9/2017 | Faulhaber |
| 9,822,181 B2 | 11/2017 | Bonvini et al. |
| 9,856,327 B2 | 1/2018 | Bernett et al. |
| 9,931,377 B2 | 4/2018 | Pavlakis et al. |
| 9,932,387 B2 | 4/2018 | LeFrancois et al. |
| 9,969,790 B2 | 5/2018 | LeFrancois et al. |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0091561 A1 | 5/2003 | Van de Winekl |
| 2003/0157108 A1 | 8/2003 | Presta |
| 2003/0223999 A1 | 12/2003 | Lindhofer |
| 2004/0018191 A1 | 1/2004 | Wang |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |

(56) References Cited

U.S. PATENT DOCUMENTS

| | | |
|---|---|---|
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0082213 A1 | 3/2009 | Horowitz et al. |
| 2009/0163699 A1 | 6/2009 | Desjarlais |
| 2009/0214539 A1 | 8/2009 | Grosmaire et al. |
| 2009/0238791 A1 | 9/2009 | Jacques et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Alley et al. |
| 2010/0004431 A1 | 1/2010 | Bernett et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0267934 A1 | 10/2010 | Van de Winkel et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Igawa et al. |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0039913 A1 | 2/2013 | Labrijn et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0131319 A1 | 5/2013 | Igawa et al. |
| 2013/0142793 A1 | 6/2013 | Ledbetter et al. |
| 2013/0171095 A1 | 7/2013 | Bernett et al. |
| 2013/0178605 A1 | 7/2013 | Blein et al. |
| 2013/0195849 A1 | 8/2013 | Von Kreudenstein et al. |
| 2013/0209355 A1 | 8/2013 | De Weers et al. |
| 2013/0267686 A1 | 10/2013 | Brinkmann |
| 2013/0336981 A1 | 12/2013 | de Kruif et al. |
| 2014/0024111 A1 | 1/2014 | Kannan et al. |
| 2014/0072581 A1 | 3/2014 | Dixit et al. |
| 2014/0086916 A1 | 3/2014 | Zha |
| 2014/0187753 A1 | 7/2014 | Blein et al. |
| 2014/0199294 A1 | 7/2014 | Mimoto et al. |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0335089 A1 | 11/2014 | Igawa et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0307629 A1 | 10/2015 | Bernett et al. |
| 2015/0351275 A1 | 12/2015 | Imbimbo et al. |
| 2016/0060360 A1 | 3/2016 | Moore et al. |
| 2016/0068584 A1 | 3/2016 | Bechard et al. |
| 2016/0068588 A1 | 3/2016 | Bernett et al. |
| 2016/0157951 A1 | 6/2016 | Schoenig et al. |
| 2016/0175459 A1 | 6/2016 | Gey et al. |
| 2016/0176969 A1 | 6/2016 | Bernett et al. |
| 2016/0184399 A1 | 6/2016 | Bechard et al. |
| 2016/0215063 A1 | 7/2016 | Bernett et al. |
| 2016/0229924 A1 | 8/2016 | Bernett et al. |
| 2016/0318986 A1 | 11/2016 | Morisseau et al. |
| 2016/0333067 A1 | 11/2016 | LeFrancois et al. |
| 2016/0347818 A1 | 12/2016 | LeFrancois et al. |
| 2016/0367635 A1 | 12/2016 | Wong et al. |
| 2017/0020963 A1 | 1/2017 | Qu et al. |
| 2017/0056874 A1 | 3/2017 | Bechard et al. |
| 2017/0088597 A1 | 3/2017 | Wong et al. |
| 2017/0145078 A1 | 5/2017 | Davis et al. |
| 2017/0151310 A1 | 6/2017 | Felber et al. |
| 2017/0233497 A1 | 8/2017 | Labrijn et al. |
| 2018/0094077 A1 | 4/2018 | Blein et al. |
| 2018/0118805 A1 | 5/2018 | Bernett et al. |
| 2018/0118828 A1 | 5/2018 | Bernett et al. |
| 2018/0127501 A1 | 5/2018 | Bernett et al. |
| 2018/0194860 A1 | 7/2018 | Von Kreudenstein et al. |
| 2018/0200366 A1 | 7/2018 | Wong et al. |
| 2018/0298079 A1 | 10/2018 | LeFrancois et al. |
| 2018/0312560 A1 | 11/2018 | Morisseau et al. |

FOREIGN PATENT DOCUMENTS

| | | |
|---|---|---|
| EP | 1752471 | 2/2007 |
| EP | 1829895 | 5/2007 |
| EP | 3263581 | 1/2008 |
| EP | 2006381 | 12/2008 |
| EP | 2009101 A1 | 12/2008 |
| EP | 2194066 | 6/2010 |
| EP | 2202245 A1 | 6/2010 |
| EP | 2522724 | 6/2011 |
| EP | 1718670 | 7/2011 |
| EP | 1934353 | 10/2011 |
| EP | 2155788 | 2/2014 |
| EP | 2388266 | 4/2014 |
| EP | 3093295 | 11/2016 |
| EP | 2769984 | 8/2017 |
| EP | 3235830 | 10/2017 |
| EP | 3252078 | 12/2017 |
| EP | 3030575 | 7/2018 |
| EP | 2724728 | 10/2018 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |
| WO | WO9640210 | 6/1996 |
| WO | WO96027011 | 9/1996 |
| WO | WO1997041232 | 11/1997 |
| WO | WO98050431 | 11/1998 |
| WO | WO199937791 | 7/1999 |
| WO | WO99054440 | 10/1999 |
| WO | WO99066951 | 12/1999 |
| WO | WO200061739 A1 | 10/2000 |
| WO | WO200124763 A2 | 4/2001 |
| WO | WO200129246 A1 | 4/2001 |
| WO | WO200162931 A1 | 8/2001 |
| WO | WO200188138 | 11/2001 |
| WO | WO2001083525 | 11/2001 |
| WO | WO2001090192 | 11/2001 |

(56) References Cited

FOREIGN PATENT DOCUMENTS

| | | |
|---|---|---|
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002083180 | 10/2002 |
| WO | WO2002098883 | 12/2002 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005063816 | 7/2005 |
| WO | WO2005085282 | 9/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO2006106905 | 12/2006 |
| WO | WO2007001677 | 1/2007 |
| WO | WO2007005612 | 1/2007 |
| WO | WO2007018431 A2 | 2/2007 |
| WO | WO2007033230 | 3/2007 |
| WO | WO2007042261 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007084342 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO20070147901 | 12/2007 |
| WO | WO2008003103 | 1/2008 |
| WO | WO2008003115 | 1/2008 |
| WO | WO2008003116 | 1/2008 |
| WO | WO2008119096 | 10/2008 |
| WO | WO2008119566 | 10/2008 |
| WO | WO2008124858 | 10/2008 |
| WO | WO2008143794 | 11/2008 |
| WO | WO2008145142 | 12/2008 |
| WO | WO2008150494 | 12/2008 |
| WO | WO2009000006 | 12/2008 |
| WO | WO2009002562 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO20100112193 | 10/2010 |
| WO | WO2010136172 | 12/2010 |
| WO | WO2010151792 | 12/2010 |
| WO | WO2010151808 | 12/2010 |
| WO | WO2011005621 | 1/2011 |
| WO | WO2011028952 | 3/2011 |
| WO | WO2011036183 | 3/2011 |
| WO | WO2011066342 | 3/2011 |
| WO | WO2011063348 | 5/2011 |
| WO | WO2011066501 | 6/2011 |
| WO | WO2011131746 | 10/2011 |
| WO | WO2011133886 | 10/2011 |
| WO | WO2011143545 | 11/2011 |
| WO | WO2011159877 | 12/2011 |
| WO | WO2012016227 | 2/2012 |
| WO | WO2012018687 | 2/2012 |
| WO | WO2012032080 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2012175222 | 12/2012 |
| WO | WO2013006544 | 1/2013 |
| WO | WO2013016714 | 1/2013 |
| WO | WO2013022855 | 2/2013 |
| WO | WO2013026833 | 2/2013 |
| WO | WO2013033008 | 3/2013 |
| WO | WO2013047748 | 4/2013 |
| WO | WO2013055809 | 4/2013 |
| WO | WO2013063702 | 5/2013 |
| WO | WO2013096828 | 6/2013 |
| WO | WO2013125667 | 8/2013 |
| WO | WO2013180201 | 12/2013 |
| WO | WO2014004586 | 1/2014 |
| WO | WO2014012085 | 1/2014 |
| WO | WO2014047231 | 3/2014 |
| WO | WO2014056783 | 4/2014 |
| WO | WO2014079000 | 5/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014164553 | 10/2014 |
| WO | WO2014170032 | 10/2014 |
| WO | WO2014209804 | 12/2014 |
| WO | WO2015018528 | 2/2015 |
| WO | WO2015018529 | 2/2015 |
| WO | WO2015026892 | 2/2015 |
| WO | WO2015063339 | 5/2015 |
| WO | WO2015095392 | 6/2015 |
| WO | WO2015095410 | 6/2015 |
| WO | WO2015103072 | 7/2015 |
| WO | WO2015103928 | 7/2015 |
| WO | WO2015131994 | 9/2015 |
| WO | WO2015143079 | 9/2015 |
| WO | WO2015149077 | 10/2015 |
| WO | WO2015168379 | 11/2015 |
| WO | WO2015184207 | 12/2015 |
| WO | WO2016014984 | 1/2016 |
| WO | WO2016028672 | 2/2016 |
| WO | WO2016028896 | 2/2016 |
| WO | WO2016079050 | 5/2016 |
| WO | WO2016086186 | 6/2016 |
| WO | WO2016086189 | 6/2016 |
| WO | WO2016086196 | 6/2016 |
| WO | WO2016095642 | 6/2016 |
| WO | WO2016105450 | 6/2016 |
| WO | WO2016141387 | 9/2016 |
| WO | WO2016182751 | 11/2016 |
| WO | WO2017019846 | 2/2017 |
| WO | WO2017112775 | 6/2017 |
| WO | WO2017210443 | 12/2017 |
| WO | WO2017210485 | 12/2017 |
| WO | WO2017214092 | 12/2017 |

(56) References Cited

FOREIGN PATENT DOCUMENTS

| WO | WO2018071918 | 4/2018 |
|---|---|---|
| WO | WO2018071919 | 4/2018 |

OTHER PUBLICATIONS (No Author Name) "A method for making multispecific antibodies having heteromultimeric and common components", Expert Opinion on Therapeutic Patents, Genentech, Inc. (1999) 9(6): 785-790, pp. 785-790.

"Polythene Glycol and Derivatives for Advanced PEGylation", Catalog 2005- 2006, Nektar Therapeutics.

"Xencor Provides Data Updates on XmaB Bispecific Antibody Program and Announces Presentations at Upcoming American Society of Hematology 2014 Annual Meeting", Nov. 6, 2014, XP055255549, retrieved from the internet: http://files.shareholder.com/downloads/AMDA-2B2V8N/0x0x792404/77590b72-837a-4085-bc55-78fa500638dc/XNCR_News_2014_11_6_General_Releases.pdf.

Abbott Laboratories, Strategies and Current Approaches for Improving Drug-Like-Properties During Biologics Drug Candidate Selection, AAPS Webinar—Nov. 10, 2011.

Adams, et al., Avidity-Mediated Enhancement of In vivo Tumor Targeting by Single-chain Fv Dimers, Clin Cancer Res, 2006, vol. 12(5), pp. 1599-1605, doi:10.1158/1078-0432.CCR-05-2217.

Alberola-Ila et al., Stimulation Through the TCR/CD3 Complex Up-Regulates the CD2 Srface Expression on Human T Lymphocytes, Feb. 15, 1991.

Alibaud et al., A New Monoclonal Anti-CD3? Antibody Reactive on Paraffin Sections, Journal of Histochemistry & Cytochemistry, 2000, vol. 48, p. 1609.

An, et al., IgG2m4, an engineered antibody isotype with reduced Fc function, mAbs, 2009, vol. 1, Issue 6, pp. 572-579, www.landesbioscience.com/journals/mabs/article/10185.

Aplin et al., Preparation, properties, and applications of carbohydrate conjugates of proteins and lipids, 1981, CRC Crit. Rev. Biochem., pp. 259-306.

Arnett, et al., Crystal structure of a human CD3-ε/δ dimer in complex with a UCHT1 single-chain antibody fragment, PNAS, 2004, vol. 101, No. 46, pp. 16268-16273.

Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.

Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.

Atwell, et al., Stable Heterodimers from Remodeling the Domain Interface of a Homodimer using a Phage Display Library, J. Mol. Biol., 1997, vol. 270, pp. 26-35.

Baca et al., Antibody humanization using monovalent phage display, 1997, J. Biol. Chem. 272(16):10678-10684.

Baeuerle, et al., Response to Letter, "Correct TandAb protein," Molecular Immunology, 2007, vol. 44, p. 3084.

Baeuerle, et al., Review—Bispecific T-Cell Engaging Antibodies for Cancer Therapy, Cancer Res, 2009, vol. 69: (12), pp. 4941-4944.

Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.

Bargou et al., Tumor Regression in Cancer Patients by Very Low Doses of a T Cell-Engaging Antibody, Science, 2008, vol. 321, pp. 974-977.

Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.

Bhatt, Sea Lane—DDD presentation, "Surrobodies™—A Novel Approach to Bispecifics . . . ," Aug. 8, 2012.

Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.

Biochemica, Your apoptosis specialist, 1999, No. 2, pp. 34-37 (Roche Molecular Biochemicals).

Bird et al., Single-chain antigen-binding proteins, 1988, Science 242:423-426.

Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.

Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.

Bortoletto, Nicola et al., "Optimizing anti-CD3 affinity for effective T cell targeting against tumor cells.", Eur J Immunol. Nov. 2002;32(11):3102-7.

Boswell et al., Effects of Charge on Antibody Tissue Distribution and Pharmacokinetics, 2010, Bioconjugate Chem, 21(21):2153-2163.

Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.

Brinkmann, et al., A recombinant immunotoxin containing a disulfide-stabilized Fv fragment, Proc. Natl. Acad. Sci. USA, 1993, vol. 90, pp. 7538-7542.

Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.

Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.

Carter et al., Antibody-drug conjugates for cancer therapy, 2008, Cancer J. 14(3):154-169.

Carter et al., Humanization of an anti-p185HER2 antibody for human cancer therapy, 1992, Proc Natl Acad Sci USA 89:4285-9.

Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.

Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.

Chames et al., Bispecific antibodies for cancer therapy—The light at the end of the tunnel?, mAbs, 2009, vol. 1, Issue 6, pp. 1-9.

Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.

Chari et al., Immunoconjugates containing novel maytansinoids: promising anticancer drugs, 1992, Cancer Research 52: 127-131.

Chatal, 1989, Monoclonal Antibodies in Immunoscintigraphy, CRC Press (Book Abstract).

Chelius, et al., Structural and functional characterization of the trifunctional antibody catumaxomab, mAbs, 2010, vol. 2, Issue 3, pp. 309-319.

Chichili et al., A CD3xCD123 bispecific DART for redirecting host T cells to myelogenous leukemia: preclinical activity and safety in nonhuman primates., Sci Transl Med. May 27, 2015;7(289):289ra82. doi: 10.1126/scitranslmed.aaa5693.

Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/

(56) References Cited

OTHER PUBLICATIONS downloads/AMDA-278VRP/0x0x935572/8CC86417-40BA-41C0-935D-EF1B7DB0B5BB/AACR_2017_-_Co-targeting_PD-1_and_CTLA-4_Inhibitory_Pathways_with_DART_and_TRIDENT_Molecules.pdf.
Chothia et al., Canonical structures for the hypervariable regions of immunoglobulins, 1987, J. Mol. Biol. 196:901-917.
Chothia et al., Structural Determinants in the Sequences of Immunoglobulin Variable Domain, J. Mol. Biol., 1998, vol. 278, pp. 457-479.
Chu et al., Immunotherapy with Long-Lived Anti-CD123 x Anti-CD3 Bispecific Antibodies Stimulates Potent T Cell Mediated Killing of Human AML Cell Lines and of CD123+ Cells in Monkeys: A Potential Therapy for Acute Myelogenous Leukemia, Blood 2014, 124:2316.
Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.
Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011.11.029. Epub Jan. 16, 2012.
Conrad, et al., TCR and CD3 Antibody Cross-Reactivity in 44 Species, Cytometry Part A, 2007, vol. 71A, pp. 925-933.
Conrath, et al., Antigen Binding and Solubility Effects upon the Veneering of a Camel VHH in Framework-2 to Mimic a VH, J. Mol. Biol. , 2005, vol. 350, pp. 112-125.
Counterman et al., "Volumes of Individual Amino Acid Residues in Gas-Phase Peptide Ions.", J. Am. Chem. Soc., 1999, 121 (16), pp. 4031-4039.
Cuesta, et al., Multivalent antibodies: when design surpasses evolution, Trends in Biotechnology, 2010, vol. 28, No. 7, pp. 355-362, doi:10.1016/j.tibtech.2010.03.007.
D'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.
Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.
Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.
Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.
De Groot et al., De-Immunization of Therapeutic Proteins by T-Cell Epitope Modification, 2005, Dev. in Biologicals, 2005, 122:171-194.
De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.
Del Nagro et al., A critical role for complement C3d and the B cell coreceptor (CD19/CD21) complex in the initiation of inflammatory arthritis., J Immunol. Oct. 15, 2005;175(8):5379-89.
Demarest et al., Antibody therapeutics, antibody engineering, and the merits of protein stability, Current Opinin in Drug Discovery & Development, 2008 11(5): 675-587, Sep. 11, 2008.
Deyev, et al., Multivalency: the hallmark of antibodies used for optimization of tumor targeting by design, BioEssays, 2008, vol. 30, pp. 904-918.
DiGiammarino et al., Ligand association rates to the inner-variable-domain of a dual-variable-domain immunoglobulin are significantly impacted by linker design, mAbs3:5, 1-8; Sep.-Oct.; 3(5):487-94, Landes Bioscience, Sep. 1, 2011.
DiGiandomenico et al., A multifunctional bispecific antibody protects against Pseudomonas aeruginosa., Sci Transl Med. Nov. 12, 2014;6(262):262ra155.doi: 10.1126/scitranslmed.3009655.
Dixon, et al., Activation of Human T Lymphocytes by Crosslinking of Anti-CD3 Monoclonal Antibodies, Journal of Leukocyte Biology, 1989, vol. 46, pp. 214-220.
Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.
Doronina , Development of potent monoclonal antibody auristatin conjugates for cancer therapy, 2003, Nat Biotechnol 21(7):778-784.
Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.
Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.
Dubowchik et al., Receptor-mediated and enzyme-dependent targeting of cytotoxic anticancer drugs, 1999, Pharm. Therapeutics 83:67-123.
Ducry et al., Antibody-drug conjugates: linking cytotoxic payloads to monoclonal antibodies, 2010, Bioconjugate Chem. 21:5-13.
Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.
Duke, et al., Measurement of apoptosis and other forms of cell death, 2004, Curr protocols immunol. 3.17.1-3.17.16.
DukSin et al., Relationship of the structure and biological activity of the natural homologues of tunicamycin, 1982, J. Biol. Chem. 257:3105.
Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.
Edge et al., Deglycosylation of glycoproteins by trifluoromethanesulfonic acid, 1981, Anal. Biochem. 118:131.
Elliott, et al., Antiparallel Conformation of Knob and Hole Aglycosylated Half-Antibody Homodimers Is Mediated by a CH2—CH3 Hydrophobic Interaction, Journal of Molecular Biology, 2014, vol. 426, Issue 9, pp. 1947-1957.
Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.
Feldmann et al., Retargeting of T Cells to Prostate Stem Cell Antigen Expressing Tumor Cells: Comparison of Different Antibody Formats, Dec. 28, 2010.
Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.
Fischer, Nicolas et al., "Bispecifc antibodies: molecules that enable novel therapeutic strategies", 2007, vol. 74, pp. 3-14.
Foreman, et al., ErbB3 Inhibitory Surrobodies Inhibit Tumor Cell Proliferation In Vitro and In Vivo, Mol Cancer Ther, 2012, vol. 11(7) , pp. 1411-1420.
Foreman, et al., PEGS poster, "ErbB3 Inhibitory Surrobodies Inhibit Tumor Cell Proliferation In Vitro and In Vivo," 2012.
Fraker et al., Crystal structure of peptide cyclo-(D-VAL-L-PRO-L-VAL-D-PRO)$_3$, 1978, Biochem. Biophys. Res. Commun. 80(4):849-57.
Francois, et al., Construction of a Bispecific Antibody Reacting with the α-and β-Chains of the Human IL-2 Receptor, The Journal of Immunology, May 15, 1993, vol. 150, No. 10, pp. 4610-4619.
F-star Modular Antibodies Fact Sheet, Apr. 2008, "Modular Antibody Technology" (w/ reference to Ruker WO 2006/072620 A1).

(56) References Cited

OTHER PUBLICATIONS

F-star Modular Antibodies Press Release, Mar. 28, 2008, "Antibody Engineering Company F-Star Buys Back Royalty Obligations. TVM Capital Joins Investor Syndicate."
Fudenberg, et al., Serologic Demonstration of Dual Specificity of Rabbit Bivalent Hybrid Antibody, The Journal of Experimental Medicine, 1964, vol. 119(1), pp. 151-166.
Ganesan, et al., FcγRIIb on Liver Sinusoidal Endothelium Clears Small Immune Complexes, The Journal of Immunology, Nov. 15, 2012, vol. 189 No. 10, pp. 4981-4988.
GenBank AAA38124.1, immunoglobulin heavy-chain VJ region [Mus musculus] Protein/NCBI, 1993.
GenBank AAA39180.1, immunoglobulin light-chain VJ region [Mus musculus] Protein/NCBI, 1993.
Ghendler et al., One of the CD3ε Subunits within a T Cell Receptor Complex Lies in Close Proximity to the Cβ FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sci. USA, 1988, vol. 85, pp. 7719-7723.
Gorman et al., Reshaping a therapeutic CD4 antibody, Proc. Natl. Acad. Sci. USA 88:4181-4185, 1991.
Grodzki & Bernstein, "Antibody Purification: Ion-Exchange Chromatography.", Methods Mol Biol 2010 ;588:27-32.
Gunasekaran et al., Enhancing Antibody Fc Heterodimer Formation through Electrostatic Steering Effects, Journal of Biological Chemistry, vol. 285, No. 25, pp. 19637-10946, Apr. 16, 2010 & Supplementary Tables.
Haagen, et al., The Efficacy of CD3 x CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.
Hakimuddin et al., A chemical method for the deglycosylation of proteins, 1987, Arch. Biochem. Biophys. 259:52.
Hamel, et al., The Role of the $V_L$- and $V_H$-Segments in the Preferential Reassociation of Immunoglobulin Subunits, Molecular Immunology, 1986, vol. 23, No. 5, pp. 503-510.
HAwkins et al, Selection of phage antibodies by binding affinity mimicking affinity maturation, 1992, J. Mol. Biol. 226:889-896.
Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.
He et al., Humanization and pharmacokinetics of a monoclonal antibody with specificity for both E- and P-selectin, 1998, J. Immunol. 160:1029-1035.
Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-8B76-60CF58B8C06F/CPI_bispecifics.pdf.
Hennecke et al., "Non-repetitive single-chain Fv linkers selected by selectively infective phage (SIP) technology.", Protein Eng. May 1998;11(5):405-10.
Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.
Hexham, et al., Influence of relative binding affinity on efficacy in a panel of anti-CD3 scFv immunotoxins, Molecular Immunology, 2001, vol. 38, pp. 397-408.
Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.

Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.
Houtenbos, et al., The novel bispecific diabody αD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain Fv-$C_H3$) which exhibits rapid, high-level targeting of xenografts, 1996, Cancer Res. 56:3055-3061.
Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Igawa, $V_H V_L$ interface engineering to promote selective expression and inhibit conformational isomerization of thrombopoietin receptor agonist single-chain diabody, Protein Engineering, Design & Selection, 2010, vol. 23, No. 8, pp. 667-677.
Ishigaki et al., Impact of Plasma Oxidized Low-Density Lipoprotein Removal on Atherosclerosis., Circulation 118: 75-83, 2008.
Jackson et al., In vitro antibody maturation, 1995, J. Immunol. 154(7):3310-9.
Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcγR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.
Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin et al. The Design and Engineering of IgG-Like Bispecific Antibodies., Chapter 9, Bispecific Antibodies, pp. 151-169, 2011.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.
Johnson et al., Anti-tumor activity of CC49-doxorubicin immunoconjugates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.
Jones et al., Replacing the complementarity-determining regions in a human antibody with those from a mouse, 1986, Nature 321:522-525.
Jordan et al., Structural understanding of stabilization patterns in engineered bispecific Ig-like antibody molecules, Proteins 2009; 77:832-841, Jun. 19, 2009.
Jung, et al., Design of interchain disulfide bonds in the framework region of the Fv fragment of the monoclonal antibody B3, Proteins, 1994, vol. 19(1), pp. 35-47.
Jung, et al., Target Cell-restricted Triggering of the CD95 (APO-1/Fas) Death Receptor with Bispecific Antibody Fragments, Cancer Research, 2001, vol. 61, pp. 1846-1848.
Jungbluth et al., A monoclonal antibody recognizing human cancers with amplification/overexpression of the human epidermal growth factor receptor, 2003, Proc Natl Acad Sci U S A. 100(2):639-44.
Kabat et al., 1991, Sequences of proteins of immunological interest, Department of Health and Human Services, Bethesda, vol. 1, $5^{th}$ Ed.
Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.
Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.

(56) References Cited

OTHER PUBLICATIONS

Kettleborough et al., Humanization of a mouse monoclonal antibody by CDR-grafting: the importance of framework residues on loop conformation, 1991, Protein Eng. 4(7):773-83.
Keyna, et al., Surrogate Light Chain-Dependent Selection of Ig Heavy Chain V Regions, J. Immunol., 1995, vol. 155, pp. 5536-5542.
Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.
Kiewe, et al., Phase I Trial of the Trifunctional Anti-HER2 x Anti-CD3 Antibody Ertumaxomab in Metastatic Breast Cancer, Clin Cancer Res., 2006, vol. 12(10), pp. 3085-3091.
Kim et al., "Localization of the site of murine IgG1 molecule that is involved in binding the murine intestinal Fc receptor," Eur. J. Immunol., 24:2429-2434, 1994.
Kim et al., Mutational approaches to improve the biophysical properties of human single-domain antibodies., Biochim Biophys Acta. Nov. 2014;1844(11):1983-2001. doi: 10.1016/j.bbapap.2014.07.008. Epub Jul. 24, 2014.
Kipriyanov, et al., Bispecific CD3 x CD19 Diabody for T Cell-Mediated Lysis of Malignant Human B Cells, Int. J. Cancer, 1998. vol. 77, pp. 763-772.
Kipriyanov, et al., Bispecific Tandem Diabody for Tumor Therapy with Improved Antigen Binding and Pharmacokinetics, J. Mol. Biol., 1999, vol. 293, pp. 41-56.
Kipriyanov, et al., Effect of Domain Order on the Activity of Bacterially Produced Bispecific Single-chain Fv Antibodies, J. Mol. Biol., 2003, vol. 330, pp. 99-111.
Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.
Klein et al., Progression of metastatic human prostate cancer to androgen independence in immunodeficient SDIC mice, 1997, Nature Medicine 3: 402-408.
Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.
Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.
Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.
Kostelny, et al., Formation of a Bispecific Antibody by the Use of Leucine Zippers, The Journal of Immunology 1992, vol. 148, pp. 1547-1553.
Krah et al., "Single-domain antibodies for biomedical applications.", Immunopharmacol Immunotoxicol. 2016;38(1):21-8. doi: 10.3109/08923973.2015.1102934. Epub Nov. 9, 2015.
Krauss et al., Specificity grafting of human antibody frameworks selected from a phage display library: generation of a highly stable humanized anti-CD22 single-chain Fv fragment, 2003, Protein Engineering 16(10):753-759.
Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi:10.1182/blood-2013-08-523548 & Data Supplement.
Kung, et al., Monoclonal Antibodies Defining Distinctive Human T Cell Surface Antigens, Science, 1979, vol. 206, pp. 347-349.
Kuppen, peter et al., The development and purification of a bispecific antibody for lymphokine-activated killer cell targeting against the rat colon carcinoma CC531., Cancer Immunol Immunother. Jun. 1993;36(6):403-8.

Labrijn, et al., Efficient generation of stable bispecific IgG1 by controlled Fab-arm exchange, www.pnas.org/cgi/doi/10.1073/pnas.1220145110 & Supporting Information; PNAS, 2013, vol. 110, No. 13, pp. 5145-5150.
Laszlo et al., Cellular determinants for preclinical activity of a novel CD33/CD3 bispecific T-cell engager (BiTE) antibody, AMG 330, against human AML, blood 2014 123: 554-561, Dec. 5, 2013.
Lau et al., Conjugation of Doxorubicin to monoclonal anti-carcinoembryonic antigen antibody via novel thiol-directed cross-linking regents, 1995, Bioorg-Med-Chem. 3(10):1299-1304.
Lau et al., Novel doxorubicin-monoclonal anti-carcinoembryonic antigen antibody immunoconjugate activity in vitro, 1995, Bioorg-Med-Chem. 3(10):1305-12.
Lazar Declaration, Dec. 27, 2010, pp. 1-4.
Lewis, et al., Generation of bispecific IgG antibodies by structure-based design of an orthogonal Fab interface, Nature Biotechnology, 2014, doi:10.1038/nbt.2797 & Supplemental Information.
Li, et al., Construction and characterization of a humanized anti-human CD3 monoclonal antibody 12F6 with effective immunoregulation functions, Immunology, 2005, vol. 116, pp. 487-498.
Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.
Ling, et al., Interspecies Scaling of Therapeutic Monoclonal Antibodies: Initial Look, J Clin Pharmacol, 2009, vol. 49, pp. 1382-1402, doi: 10.1177/0091270009337134.
Link, et al., Production and Characterization of a Bispecific IgG Capable of Inducing T-Cell-Mediated Lysis of Malignant B Cells, Blood, 1993, vol. 81, No. 12, pp. 3343-3349.
Linke, et al., Catumaxomab, Clinical development and future directions, mAbs, 2010, vol. 2, Issue 2, pp. 129-136.
Little, et al., Letter to the Editor, "Flawed TandAb production," Molecular Immunology, 2007, vol. 44, p. 3083.
Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.
Liu et al., Eradication of large colon tumor xenografts by targeted delivery of maytansinoids, 1996 Proc. Natl. Acad. Sci. USA 93:8618-8623.
Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.
Lode et al., Targeted therapy with a novel enediyene antibiotic calicheamicins $o^i_1$ effectively suppress growth and dissemination of liver metastases in a syngeneic model of murine neuroblastoma, 1998, Cancer Res. 58:2928.
Löffler, et al., A recombinant bispecific single-chain antibody, CD19 x CD3, induces rapid, and high lymphoma-directed cytotoxicity by unstimulated T lymphocytes, Blood, 2000, vol. 95, No. 6, pp. 2098-2103.
Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.
Lu, et al., Di-diabody: a novel tetravalent bispecific antibody molecule by design, Journal of Immunological Methods, 2003, vol. 279, pp. 219-232.
Lu, et al., Fab-scFv fusion protein: an efficient approach to production of bispecific antibody fragments, Journal of Immunological Methods, 2002, vol. 267, pp. 213-226.
Lu, et al., The effect of variable domain orientation and arrangement on the antigen-binding activity of a recombinant human bispecific diabody, Biochemical and Biophysical Research Communications, 2004, vol. 318, pp. 507-513.
Lum, et al., The new face of bispecific antibodies: targeting cancer and much more, Experimental Hematology, 2006, vol. 34, pp. 1-6.
Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.

(56) References Cited

OTHER PUBLICATIONS

Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.

Ma, et al., Expression and Characterization of a Divalent Chimeric Anti-Human CD3 Single Chain Antibody, Scand.J.Immunol, 1996, vol. 43, pp. 134-139.

Mabry, et al., A dual-targeting PDGFRβ/VEGF-A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.

Mabry, et al., Engineering of stable bispecific antibodies targeting 1L-17A and 1L-23, Protein Engineering, Design & Selection, 2009, vol. 23, No. 3, pp. 115-127; doi:10.1093/protein/gzp073 & Supplementary Figures 1-8.

Mack, et al., A small bispecific antibody construct expressed as a functional single-chain molecule with high tumor cell cytotoxicity, Proc. Natl. Acad. Sci. USA, 1995, vol. 92, pp. 7021-7025.

Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.

MacroGenics Factsheet, Dual Affinity Re-Targeting ("DART") Platform, 2010.

Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.

Mandler et al., Modifications in synthesis strategy improve the yield and efficacy of geldanamycin-herceptin immunoconjugates, 2002, Bioconjugate Chem. 13:786-791).

Mandler et al., Synthesis and evaluation of antiproliferative activity of a geldanaymcin-herceptin™ immunoconjugates, 2000, Bioorganic & Med. Chem. Letters 10:1025-1028.

Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.

Mandy, et al., Recombination of Univalent Subunits Derived from Rabbit Antibody, The Journal of Biological Chemistry, 1961, vol. 236, No. 12, pp. 3221-3226.

Marks et al., By-passing immunization: building high affinity human antibodies by chain shuffling, 1992, Biotechnology 10:779-783.

Martin, et al., Generation of the Germline Peripheral B Cell Repertoire: VH81X-λ B Cells Are Unable to Complete All Developmental Programs, J. Immunol., 1998, vol. 160, pp. 3748-3758.

Martinez, et al., Characterization of a novel modification on IgG2 light chain: Evidence for the presence of O-linked mannosylation, J. Chromatogr. A, 2007, vol. 1156 pp. 183-187.

Marvin, Bispecific antibodies for dual-modality cancer therapy: killing two signaling cascades with one stone, Curr Opin Drug Discov Devel, 2006, vol. 9(2), pp. 184-193.

Marvin, et al., Recombinant approaches to IgG-like bispecific antibodies, Acta Pharmacologica Sinica, 2005, vol. 26 (6), pp. 649-658.

Mateo et al, Humanization of a mouse nonoclonal antibody that blocks the epidermal growth factor receptor: recovery of antagonistic activity, 1997, Immunotechnology, 3(1):71-81.

McPhee, Engineering human immunodeficiency virus 1 protease heterodimers as macromolecular inhibitors of viral maturation, Proc. Natl. Acad. Sci. USA, 1996, vol. 93, pp. 11477-11481.

Meijer, et al., Isolation of Human Antibody Repertoires with Preservation of the Natural Heavy and Light Chain Pairing, J. Mol. Biol., 2006, vol. 358, pp. 764-772.

Merchant, et al., An efficient route to human bispecific IgG, Nature Biotechnology, 1998, vol. 16, pp. 677-681.

Mertens, Nico, "Tribodies: Fab-scFv fusion proteins as a platform to create multi-functional pharmaceuticals.", SpringerLink 2011, 135-149.

Metz, et al., Bispecific antibody derivatives with restricted binding functionalities that are activated by proteolytic processing, Protein Engineering, Design & Selection, 2012, vol. 25, No. 10, pp. 571-580.

Metz, et al., Bispecific digoxigenin-binding antibodies for targeted payload delivery, PNAS, 2011, vol. 108, No. 20, pp. 8194-8199.

Michaelson et al., Anti-tumor activity of stability-engineered IgG-like bispecific antibodies targeting Trail-R2 and LTbetaR, [mAbs 1:2, 128-141; Mar./Apr. 2009]; Mar. 11, 2009.

Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.

Miller et al., Stability engineering of scFvs for the development of bispecific and multivalent antibodies, PEDS, 2010, vol. 23, No. 7, pp. 549-557 & Supplementary Data.

Miller, biogen idec Stability Engineering and Production of IgG-like Bispecifc Antibodies, AAPS National Biotechnology Conference, Jun. 24 to Jun. 27, 2007.

Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency", 2013.

Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.

Mimoto, et al., Novel asymmetrically engineered antibody Fc variant with superior FcγR binding affinity and specificity compared with afucosylated Fc variant, mAbs, 2013, vol. 5, Issue 2, pp. 229-236.

Modjtahedi et al, Phase I trial and tumour localization of the anti-EGFR monoclonal antibody ICR62 in head and neck or lung cancer, 1996, Br J Cancer, 73(2):228-35.

Modjtahedi et al, Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.

Modjtahedi et al., Antitumor activity of combinations of antibodies directed against different epitopes on the extracellular domain of the human EGF receptor, 1993, J. Cell Biophys. 1993, 22(1-3):129-46.

Modjtahedi et al., The human EGF receptor as a target for cancer therapy: six new rat mAbs against the receptor on the breast carcinoma MDA-MB 468, 1993, Br J Cancer. 1993, 67(2):247-53.

Mølhøj, et al., CD19-/CD3-bispecific antibody of the BiTE class is far superior to tandem diabody with respect to redirected tumor cell lysis, Molecular Immunology 2007, vol. 44 , pp. 1935-1943.

Moore et al., Tuning T Cell Affinity Improves Efficacy and Safety of Anti-CD38 x Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.

Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.

Moore, et al., Application of dual affinity retargeting molecules to achieve optimal redirected T-cell killing of B-cell lymphoma, Blood, 2011, vol. 117, No. 17, pp. 4542-4551.

Moretti et al., BEAT® the bispecific challenge: a novel and efficient platform for the expression of bispecific IgGs. BMC Proceedings 2013 7(Suppl 6):O9.

Morrison, et al., News and Views: Two heads are better than one, Nature Biotechnology, 2007, vol. 25, No. 11, pp. 1233-1234.

Mosmann, 1983, Rapid colorimetric assay for cellular growth and survival: application to proliferation and cytotoxicity assays, J. Immunol. Methods 65:55-63.

Muda, et al., Therapeutic assessment of SEED: a new engineered antibody platform designed to generate mono and bispecific antibodies, Protein Engineering, Design & Selection, 2011, vol. 24, No, 5, pp. 447-454.

(56) References Cited

OTHER PUBLICATIONS

Muramatsu et al., Production and characterization of an active single-chain variable fragment antibody recognizing CD25., Cancer Lett. Jul. 28, 2005;225(2):225-36. Epub Jan. 23, 2005.
Murthy et al., Binding of an antagonistic monoclonal antibody to an intact and fragmented EGF-receptor polypeptide, 1987, Arch Biochem Biophys. 252(2):549-60.
Nagorsen, et al., Blinatumomab: A historical perspective, Pharmacology & Therapeutics, 2012, vol. 136, pp. 334-342, http://dx.doi.org/10.1016/j.pharmthera.2012.07.013.
Nelson, et al., Point of View: Antibody fragments—Hope and hype, mAbs, 2010, vol. 2, Issue 1, pp. 77-83.
Neville et al., Enhancement of immunotoxin efficacy by acid-cleavable cross-ling agents utilizing diphtheria toxin and toxin mutants, 1989, Biol. Chem. 264:14653-14661.
Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.
O'Connor et al., Humanization of an antibody against human protein C and calcium-dependence involving framework residues, 1998, Protein Eng 11:321-8.
Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432.CCR-13-0143.
Page et al., 1993, Intermantional. Journal of Oncology 3:473-476.
Panke, et al., Quantification of cell surface proteins with bispecific antibodies, Protein Engineering, Design & Selection, 2013, vol. 26, No. 10, pp. 645-654.
Pessano, et al., The T3/T cell receptor complex: antigenic distinction between the two 20-kd T3 (T3-δ and T3-ε) subunits, The EMBO Journal, 1985, vol. 4, No. 2, pp. 337-344.
Pettit et al., Antineoplastic agents 365. Dolastatin 10 SAR probes, 1998, Anti-Cancer Drug Design 13:243-277.
Pettit et al., Dolastatins 24. Synthesis of (−)-dolastatin 10.I X-ray molecular structure of N,N-dimethylvalyl-valyl-dolaisoleuine tert-butyl ester, 1996, J. Chem. Soc. Perkin Trans. 1 5:859-863.
Pettit et al., Specific activities of dolastatin 10 and peptide derivatives against Cryptococcus neoformans, 1998, Antimicrob. Agents Chemother. 42(11):2961-2965.
Pettit et al., Structure-activity studies with chiral isomers and with segments of the antimitotic marine peptide dolastation 10, 1989, J. Am. Chem. Soc. 111:5463-5465.
Pettit, et al., The dolastatins; 18: Sterospecific synthesis of dolaproine1, 1996, Synthesis 719-725.
Pichler et al., Differences of T-Cell Activation by the Anti-CD3 Antibodies Leu4 and BMA030, Mar. 30, 1987.
Potapov et al., Protein—Protein Recognition: Juxtaposition of Domain and Interface Cores in Immunoglobulins and Other Sandwich-like Proteins, J. Mol. Biol., 2004, vol. 342, pp. 665-679.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95: 8910-8915.
Raghavan et al., Fc receptors and their interactios with immunoglobulins, 1996, Annu Rev Cell Dev Biol 12:181-220.
Rattel, et al., AACR Poster, "Validation of Cynomolgus Monkeys as Relevant Species for Safety Assessment of a Novel Human BiTE Antibody Platform for Cancer Therapy," 2010.
Reddy et al., Elimination of Fc receptor-dependent effector functions of a modified IgG4 monoclonal antibody to human CD4., J Immunol. Feb. 15, 2000;164(4):1925-33.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Remington's Pharmaceutical Sciences 16th edition, Osol, A. Ed. (1980) (Book Abstract).
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering,1996, vol. 9, No. 7, pp. 617-621.
Riechmann et al., Reshaping human antibodies for therapy, 1988, Nature 332:323-329.
Riethmüller, Symmetry breaking: bispecific antibodies, the beginnings, and 50 years on, Cancer Immunity, 2012, vol. 12, p. 12, pp. 1-7.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roosnek, et al., Triggering T Cells by Otherwise Inert Hybrid Anti-CD3/Antitumor Antibodies Requires Encounter with the Specific Target Cell, J . Exp. Med., 1989, vol. 170, pp. 297-302.
Roque et al., Antibodies and genetically engineered related molecules: production and purification, 2004, Biotechnol. Prog. 20:639-654.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure , 2011, vol. 19, pp. 1274-1282.
Rosok et al., A combinatorial library strategy for the rapid humanization of anticarcinoma BR 96 Fab, 1996, J. Biol. Chem. 271(37): 22611-22618.
Rossi, et al., A new class of bispecific antibodies to redirect T cells for cancer immunotherapy, mAbs 2014, vol. 6, Issue 2, pp. 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.
Röthlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.
Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3-Surface Expression Is Required for CD4-p56ick-mediated Up-regulation of T Cell Antigen Receptor-CD3 Signaling in T Cells, Apr. 16, 1992.

(56) References Cited

OTHER PUBLICATIONS

Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.

Schaefer, et al., Immunoglobulin domain crossover as a generic approach for the production of bispecific IgG antibodies, PNAS, 2011, vol. 108, No. 27, pp. 11187-11192.

Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.

Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.

Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.

Schoonjans, et al., Fab Chains as an Efficient Heterodimerization Scaffold for the Production of Recombinant Bispecific and Trispecific Antibody Derivatives, The Journal of Immunology, 2000, vol. 165, pp. 7050-7057.

Schroder et al., The Peptides, vol. pp. 76-136, 1965, Academic Press.

Senter et al, Proceedings of the American Association for Cancer Research, 2004, vol. 45, Abstract No. 623.

Senter, Potent antibody drug conjugates for cancer therapy, 2009, Current Opin. Chem. Biol. 13:235.

Sforzini et al., Targeting of saporin to Hodgkin's lymphoma cells by anti-CD30 and anti-CD25 bispecific antibodies., Br J Haematol. Sep. 1998;102(4):1061-8.

Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.

Shan, et al., Characterization of scFv-Ig Constructs Generated from the Anti-CD20 mAb 1F5 Using Linker Peptides of Varying Lengths, J Immunol, 1999, vol. 162, pp. 6589-6595.

Shearman, et al., Construction, Expression and Characterization of Humanized Antibodies Directed Against the Human α/β T Cell Receptor, The Journal of Immunology, 1991, vol. 147, No. 12, pp. 4366-4373.

Shen, et al., Catumaxomab, a rat/murine hybrid trifunctional bispecific monoclonal antibody for the treatment of cancer, Curr Opin Mol Ther, 2008, vol. 10(3), pp. 273-284.

Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.

Shields et al., Lack of fucose on human IgG1 N-linked oligosaccharide improves binding to human FcγRIII and antibody-dependent cellular toxicity, 2002, J Biol Chem 277:26733-26740.

Shier et al., Identification of functional and structural amino-acid residues by parsimonious mutagenesis, 1995, Gene 169:147-155.

Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.

Skehan et al., Identification of functional and structural amino-acid residues by parsimonious mutagenesis, 1990, J. Natl. Cancer Inst. 82(13):1107-12.

Smith et al., Mouse model recapitulating human Fcγ receptor structural and functional diversity., Proc Natl Acad Sci U S A. Apr. 17, 2012;109(16):6181-6. doi: 10.1073/pnas.1203954109. Epub Apr. 2, 2012.

Soumyarani et al, Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.

Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.

Spiess, et al., Bispecific antibodies with natural architecture produced by co-culture of bacteria expressing two distinct half-antibodies, Nature Biotechnology, 2013, doi:10.1038/nbt.2621 & Supplemental Information.

Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.

Stamova, Unexpected recombinations in single chain bispecific anti-CD3-anti-CD33 antibodies can be avoided by a novel linker module, Oct. 29, 2011.

Stanfield, et al. Maturation of Shark Single-domain (IgNAR) Antibodies: Evidence for Induced-fit Binding, J. Mol. Biol., 2007, vol. 367, pp. 358-372.

Stewart, et al., Recombinant CD36 inhibits oxLDL-induced ICAM-1-dependent monocyte adhesion., Mol Immunol. Feb. 2006;43(3):255-67.

Strop, P. et al., Generating Bispecific Human IgG1 and IgG2 Antibodies from Any Antibody Pair, J. Mol. Biol., 2012, doi:10.1016/j.jmb.2012.04.020.

Szymkowski et al., Creating the next generation of protein therapeutics through rational drug design, Current opinion in drug discovery & development, Sep. 1, 2005, p. 590, XP055354917, England.

Tabrizi et al., Biodistribution mechanisms of therapeutic monoclonal antibodies in health and disease., AAPS J. Mar. 2010;12(1):33-43. doi: 10.1208/s12248-009-9157-5. Epub Nov. 19, 2009.

Tan et al., "Superhumanized" antibodies: reduction of immunogenic potential by complementarity-determining region grafting with human germline sequences: application to an anti-CD28, 2002, J. Immunol. 169:1119-1125.

Tan, Philip, Presentation at PepTalk, Jan. 25, 2013, "Bi-specific ADAPTIR Molecule Targeting CD86 and Delivering Monomeric IL10 to Inhibit Antigen Presenting Cells".

Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-19258.

Tarcsa et al, Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.

Teachey, et al., Cytokine release syndrome after blinatumomab treatment related to abnormal macrophage activation and ameliorated with cytokine-directed therapy, Blood, 2013, vol. 121, No. 26, pp. 5154-5157.

Tedgui, et al., Cytokines in atherosclerosis: pathogenic and regulatory pathways., Physiol Rev. Apr. 2006;86(2):515-81.

Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.

Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.

Thompson, et al., Improved binding of a bivalent single-chain immunotoxin results in increased efficacy for in vivo T-cell depletion, Protein Engineering, 2001, vol. 14, No. 12, pp. 1035-1041.

Thorne, et al., CD36 is a receptor for oxidized high density lipoprotein: implications for the development of atherosclerosis., FEBS Lett. Mar. 20, 2007;581(6):1227-32. Epub Feb. 28, 2007.

Thorpe et al., New coupling agents for the synthesis of immunotoxins containing a hindered disulfide bond with improved stability in Vivo, 1987, Cancer Res. 47:5924-5931.

(56) References Cited

OTHER PUBLICATIONS

Thotakura et al., Enzymatic deglycosylating of glycoproteins, 1987, Meth. Enzymol. 138:350.
Thurman et al., Detection of complement activation using monoclonal antibodies against C3d., J Clin Invest. May 2013;123(5):2218-30. doi: 10.1172/JCI65861. Epub Apr. 24, 2013.
Tomlinson et. al., Methods for generating multivalent and bispecific antibody fragments, 2000, Methods Enzymol. 326:461-479.
Topp, et al., Targeted Therapy With the T-Cell-Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498, 2011.
Traunecker, et al., Bispecific single chain molecules (Janusins) target cytotoxic lymphocytes on HIV infected cells, The EMBO Journal, 1991, vol. 1, No. 12, pp. 3655-3659.
Tsurushita et al., Humanization of monoclonal antibodies, 2004, Molecular Biology of B Cells 533-545.
Umaña et al., Engineered glycoforms of an antineuro-blastoma IgG1 with optimized antibody-dependent cellular cytotoxic activity, 1999, Nat Biotechnol 17:176-180.
Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.
Van Boxel, et al., Some lessons from the systematic production and structural analysis of soluble αβ T-cell receptors, Journal of Immunological Methods, 2009, vol. 350, pp. 14-21.
Van Wauwe, et al., OKT3: A Monoclonal Anti-Human T Lymphoctye Antibody with Potent Mitogenic Properties, The Journal of Immunology, 1980, vol. 124, No. 6, pp. 2708-2713.
Verdier, et al., Determination of lymphocyte subsets and cytokine levels in Cynomolgus monkeys, Toxicology, 1995, vol. 105, pp. 81-90.
Verhoeyen et al., Reshaping human antibodies: grafting an antilysozyme activity, 1988, Science, 239:1534-1536.
Veri, et al., Therapeutic Control of B Cell Activation via Recruitment of Fcγ Receptor IIb (CD32B) Inhibitory Function With a Novel Bispecific Antibody Scaffold, Arthritis & Rheumatism, 2010, vol. 62, No. 7, pp. 1933-1943.
Vettermann, et al., Powered by pairing: The surrogate light chain amplifies immunoglobulin heavy chain signaling and pre-selects the antibody repertoire, Seminars in Immunology 18, 2006, pp. 44-55.
Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.
Wang et al., Conserved amino acid networks involved in antibody variable domain interactions, Proteins, 2009, vol. 76, pp. 99-114.
Wang et al., Expression and characterization of recombinant soluble monkey CD3 molecules: mapping the FN18 polymorphic epitope, Molecular Immunology, 2004, vol. 40, pp. 1179-1188.
Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.
Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.
Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55, 1988.
Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.
Weiner, et al., The Role of T Cell Activation Bispecific Antibody Therapy in Anti-CD3 X Antitumor, Journal of Immunology, 1994, vol. 152, pp. 2385-2392.

Wesolowski, et al., Single domain antibodies: promising experimental and therapeutic tools in infection and immunity, Med Microbiol Immunol, 2009, vol. 198, pp. 157-174.
Whitlow, et al., An improved linker for single-chain Fv with reduced aggregation and enhanced proteolytic stability, Protein Engineering, 1993, vol. 6, No. 8, pp. 989-995.
Wigginton et al., An immunoglobulin E-reactive chimeric human immunoglobulin G1 anti-idiotype inhibits basophil degranulation through cross-linking of FcεRI with FcγRIIb., Clinical & Experimental Allergy, 38: 313-319, 2007.
Wong, et al., The Mechanism of Anti-CD3 Monoclonal Antibodies, Transplantation, 1990, vol. 50, No. 4, pp. 683-689.
Woods, et al., LC-MS characterization and purity assessment of a prototype bispecific antibody, mAbs, 2013, vol. 5, Issue 5, pp. 711-722, http://dx.doi.org/10.4161/mabs.25488.
Woyke et al., In vitro activities and postantifungal effects of the potent dolastation 10 derivative auristatin PHE, 2001, Antimicrob. Agents and Chemother. 45(12):3580-3584.
Wu et al, Molecular construction and optimization of anti-human IL-11α/β dual variable domain immunoglobulin (DVD-Ig™) molecules, [mAbs 1:4, 339-347; Jul./Aug. 2009]; Landes Bioscience, Apr. 10, 2009.
Wu et al, Simultaneous targeting of multiple disease mediators by a dual-variable-domain immunoglobulin, (DVD-Ig™) molecules, Jul.-Aug. 2009; 339-347, Oct. 14, 2007.
Wu et al., Humanization of a murine monoclonal antibody by simultaneous optimization of framework and CDR residues, 1999, J. Mol. Biol. 294:151-162.
Wu, et al., Multimerization of a chimeric anti-CD20 single-chain Fv-Fc fusion protein is mediated through variable domain exchange, Protein Engineering, 2001, vol. 14, No. 12, pp. 1025-1033.
Wucherpfennig, et al., Structural Biology of the T-cell Receptor: Insights into Receptor Assembly, Ligand Recognition, and Initiation of Signaling, Cold Spring Harb Perspect Biol 2010;2:a005140.
Xie, et al., A new format of bispecific antibody: highly efficient heterodimerization, expression and tumor cell lysis, Journal of Immunological Methods, 2005, vol. 296, pp. 95-101, doi:10.1016/j.jim.2004.11.005.
Xu, et al., Combinatorial surrobody libraries, PNAS, 2008, vol. 105, No. 31, pp. 10756-10761.
Xu, et al., Rapid optimization and prototyping for therapeutic antibody-like molecules, mAbs, 2013, vol. 5, Issue 2, pp. 237-254.
Xu, et al., Surrobodies with Functional Tails, J. Mol. Biol., 2010, vol. 397, pp. 352-360.
Yang et al., Differential in vitro activation of CD8-CD4+ and CD4-CD8+ T lymphocytes by combinations of anti-CD2 and anti-CD3 antibodies, Apr. 1, 1988.
Yelton et al., Affinity maturation of the BR96 anti-carcinoma antibody by codon-based mutagenesis, 1995, J. Immunol. 155:1994-2004.
Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.
Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.
Yu et al., The biosynthetic gene cluster of the maytansinoids antitumor agent ansamitocin from actinosynnema pretiosum, 2002, PNAS 99:7968-7973.
Zalevsky et al. "Enhanced antibody half-life improves in vivo activity." Nature Biotechnology, vol. 28, No. 2, Feb. 1, 2010, pp. 157-159.
Zamyatnin AA., Amino acid, peptide, and protein volume in solution., Annu Rev Biophys Bioeng. 1984;13:145-65.
Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.

(56) References Cited

OTHER PUBLICATIONS

Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.

Zhu, et al., Remodeling domain interfaces to enhance heterodimer formation, Protein Science, 1997, vol. 6, pp. 781-788.

Ziebig et al., Effect of the oxLDL Binding Protein Fc-CD68 on Plaque Extension and Vulnerability in Atherosclerosis., Circulation Research 108: 695-703, 2011.

Zuo, et al., An efficient route to the production of an IgG-like bispecific antibody, Protein Engineering, 2000, vol. 13, No. 5, pp. 361-367.

Chu et al., Immunotherapy with Long-Lived Anti-CD123 x Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.

Sun et al., Anti-CD20/CD3 T cell-dependent bispecific antibody for the treatment of B cell malignancies., Science Translational Medicine May 13, 2015: vol. 7, Issue 287, pp. 287ra70 DOI: 10.1126/scitranslmed.aaa480.

Capizzi et al., Curative chemotherapy for acute myeloid leukemia: the development of high-dose ara-C from the laboratory to bedside., Invest New Drugs. 1996;14(3):249-56.

Giles et al., Intravenous corticosteroids to reduce gemtuzumab ozogamicin infusion reactions. Ann Pharmacother. Sep. 2003;37(9):1182-5.

Duong et al., Targeted treatment of acute myeloid leukemia in older adults: role of gemtuzumab ozogamicin., Clin Interv Aging. 2009;4:197-205. Epub May 14, 2009.

Sun et al. , Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.

Gantke et al., Trispecific antibodies for CD16A-directed NK cell engagement and dual-targeting of tumor cells., Protein Eng Des Sel. Sep. 1, 2017;30(9):673-684. doi: 10.1093/protein/gzx043.

Zhang et al., The development of bispecific antibodies and their applications in tumor immune escape., Experimental Hematology & Oncology20176:12.

Krupka et al.,Blockade of the PD-1/PD-L1 axis augments lysis of AML cells by the CD33/CD3 BiTE antibody construct AMG 330: reversing a T-cell-induced immune escape mechanism., Leukemia. Feb. 2016;30(2):484-91. doi: 10.1038/leu.2015.214. Epub Aug. 4, 2015.

Osada et al., CEA/CD3-bispecific T cell-engaging (BiTE) antibody-mediated T lymphocyte cytotoxicity maximized by inhibition of both PD1 and PD-L1., Cancer Immunol Immunother. Jun. 2015;64(6):677-88. doi: 10.1007/s00262-015-1671-y. Epub Mar. 6, 2015.

Masarova et al., Immune Checkpoint Approaches in AML and MDS: A Next Frontier?, The Journal of Targeted Therapies in Cancer, Mar. 6, 2017 (Mar. 6, 2017), XP002784099.

Scott et al., Antibody therapy of cancer., Nat Rev Cancer. Mar. 22, 2012;12(4):278-87. doi: 10.1038/nrc3236.

Chappel et al., "Identification of a Secondary Fcγ RI Binding Site within a Genetically Engineered Human IgG Actibody," J. Biol. Chem., 268(33):25124-25131 (Nov. 1993).

Chappel et al., "Identification of the Fcγ receptor class I binding site in human IgG through the use of recombinant IgG1/IgG2 hybrid and point-mutated antibodies," PNAS, USA, 88:9036-9040 (Oct. 1991).

Miranda-Carus et al., IL-15 and the initiation of cell contact-dependent synovial fibroblast-T lymphocyte cross-talk in rheumatoid arthritis: effect of methotrexate., 2004 J. Immunol. 13:1463-1476.

Koka et al, Cutting edge: murine dendritic cells require IL-15R alpha to prime NK cells., 2004 J. Immunol. 173:3594-3598.

Matsumoto et al., On-column refolding and characterization of soluble human interleukin-15 receptor alpha-chain produced in *Escherichia coli.*, Protein Purification and Expression, 2003 64-71.

Schluns et al., Distinct cell types control lymphoid subset development by means of IL-15 and IL-15 receptor alpha expression., PNAS 101(5):5616-5621.

Wei et al., The Sushi domain of soluble IL-15 receptor alpha is essential for binding IL-15 and inhibiting inflammatory and allogenic responses in vitro and in vivo., J. Immunol. 167:277-282.

Figure 2A

Human IL-15 precursor sequence (SEQ ID NO: 5)

>sp|P40933
MRISKPHLRSISIQCYLCLLLNSHFLTEAGIHVFILGCFSAGLPKTEANWVNVISDLKKIEDLIQSMHIDATLYT
ESDVHPSCKVTAMKCFLLELQVISLESGDASIHDTVENLIILANNSLSSNGNVTESGCKECEELEEKNIKEFLQS
FVHIVQMFINTS

Human IL-15 mature form sequence (SEQ ID NO: 6)

>sp|P40933|49-162
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Human IL-15Rα sequence (SEQ ID NO: 7)

>sp|Q13261
MAPRRARGCRTLGLPALLLLLLLRPPATRGITCPPPMSVEHADIWVKSYSLYSRERYICNSGFKRKAGTSSLTEC
VLNKATNVAHWTTPSLKCIRDPALVHQRPAPPSTVTTAGVTPQPESLSPSGKEPAASSPSSNNTAATTAAIVPGS
QLMPSKSPSTGTTEISSHESSHGTPSQTTAKNWELTASASHQPPGVYPQGHSDTTVAISTSTVLLCGLSAVSLLA
CYLKSRQTPPLASVEMEAMEALPVTWGTSSRDEDLENCSHHL

Human IL-15Rα, extracellular domain (SEQ ID NO: 8)

>sp|Q13261|31-205
ITCPPPMSVEHADIWVKSYSLYSRERYICNSGFKRKAGTSSLTECVLNKATNVAHWTTPSLKCIRDPALVHQRPA
PPSTVTTAGVTPQPESLSPSGKEPAASSPSSNNTAATTAAIVPGSQLMPSKSPSTGTTEISSHESSHGTPSQTTA
KNWELTASASHQPPGVYPQGHSDTT

Human IL-15Rα, sushi domain (SEQ ID NO: 9)

>sp|Q13261|31-95
ITCPPPMSVEHADIWVKSYSLYSRERYICNSGFKRKAGTSSLTECVLNKATNVAHWTTPSLKCIR

Human IL-15Rβ sequence (SEQ ID NO: 10)

>sp|P14784
MAAPALSWRLPLLILLLPLATSWASAAVNGTSQFTCFYNSRANISCVWSQDGALQDTSCQVHAWPDRRRWNQTCE
LLPVSQASWACNLILGAPDSQKLTTVDIVTLRVLCREGVRWRVMAIQDFKPFENLRLMAPISLQVVHVETHRCNI
SWEISQASHYFERHLEFEARTLSPGHTWEEAPLLTLKQKQEWICLETLTPDTQYEFQVRVKPLQGEFTTWSPWSQ
PLAFRTKPAALGKDTIPWLGHLLVGLSGAFGFIILVYLLINCRNTGPWLKKVLKCNTPDPSKFFSQLSSEHGGDV
QKWLSSPFPSSSFSPGGLAPEISPLEVLERDKVTQLLLQQDKVPEPASLSSNHSLTSCFTNQGYFFFHLPDALEI
EACQVYFTYDPYSEEDPDEGVAGAPTGSSPQPLQPLSGEDDAYCTFPSRDDLLLFSPSLLGGPSPPSTAPGGSGA
GEERMPPSLQERVPRDWDPQPLGPPTPGVPDLVDFQPPPELVLREAGEEVPDAGPREGVSFPWSRPPGQGEFRAL
NARLPLNTDAYLSLQELQGQDPTHLV

Human IL-15Rβ, extracellular domain (SEQ ID NO: 11)

>sp|P14784|27-240
AVNGTSQFTCFYNSRANISCVWSQDGALQDTSCQVHAWPDRRRWNQTCELLPVSQASWACNLILGAPDSQKLTTV
DIVTLRVLCREGVRWRVMAIQDFKPFENLRLMAPISLQVVHVETHRCNISWEISQASHYFERHLEFEARTLSPGH
TWEEAPLLTLKQKQEWICLETLTPDTQYEFQVRVKPLQGEFTTWSPWSQPLAFRTKPAALGKDT

Figure 2B

Human common gamma chain sequence (SEQ ID NO: 12)

```
>sp|P31785
MLKPSLPFTSLLFLQLPLLGVGLNTTILTPNGNEDTTADFFLTTMPTDSLSVSTLPLPEVQCFVFNVEYMNCTWN
SSSEPQPTNLTLHYWYKNSDNDKVQKCSHYLFSEEITSGCQLQKKEIHLYQTFVVQLQDPREPRRQATQMLKLQN
LVIPWAPENLTLHKLSESQLELNWNNRFLNHCLEHLVQYRTDWDHSWTEQSVDYRHKFSLPSVDGQKRYTFRVRS
RFNPLCGSAQHWSEWSHPIHWGSNTSKENPFLFALEAVVISVGSMGLIISLLCVYFWLERTMPRIPTLKNLEDLV
TEYHGNFSAWSGVSKGLAESLQPDYSERLCLVSEIPPKGGALGEGPGASPCNQHSPYWAPPCYTLKPET
```

Human common gamma chain, extracellular domain (SEQ ID NO: 13)

```
>sp|P31785|23-262
LNTTILTPNGNEDTTADFFLTTMPTDSLSVSTLPLPEVQCFVFNVEYMNCTWNSSSEPQPTNLTLHYWYKNSDND
KVQKCSHYLFSEEITSGCQLQKKEIHLYQTFVVQLQDPREPRRQATQMLKLQNLVIPWAPENLTLHKLSESQLEL
NWNNRFLNHCLEHLVQYRTDWDHSWTEQSVDYRHKFSLPSVDGQKRYTFRVRSRFNPLCGSAQHWSEWSHPIHWG
SNTSKENPFLFALEA
```

Figure 3A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 3B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 3C

| Monomer 1 | Monomer 2 |
| --- | --- |
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 3D

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |

Figure 3E

| Monomer 1 | Monomer 2 |
|---|---|
| K392D/K409D | E356K/D399K |
| K370D/K392D/K409D | E356K/E357K/D399K |
| K247Q/R355Q/N384S/K392N/V397M/Q419E/K447_ | P217R/P228R/N276K |
| K247Q/R355Q/N384S/K392N/V397M/Q419E/K447_ | N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| K247Q/R355Q/Q419E/K447_ | P217R/P228R/N276K |
| K247Q/R355Q/Q419E/K447_ | N276K |
| K274Q/R355Q/N384S/K392N/V397M/Q419E/K447_ | |
| Q295E/N384D/Q418E/N421D | |
| Q295E/Q418E/N421D | |
| P217R/P228R/N276K | |
| N276K | |
| E269Q/E272Q/E283Q/E357Q | |
| E269Q/E272Q/E283Q | |
| E269Q/E272Q | |
| E269Q/E283Q | |
| E272Q/E283Q | |
| E269Q | |

Figure 4

| Variant constant region | Substitutions |
|---|---|
| pI_ISO(-)-Fc only | K274Q/R355Q/N384S/K392N/V397M/Q419E/K447_ |
| pI_(-)_isosteric A-Fc only | Q295E/N384D/Q418E/N421D |
| pI_(-)_isosteric_B-Fc only | Q295E/Q418E/N421D |
| pI_ISO(+RR)-Fc only | P217R/P228R/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

Figure 5

Ablation Variants
G236R
S239G
S239K
S239Q
S239R
V266D
S267K
S267R
H268K
E269R
299R
299K
K322A
A327G
A327L
A327N
A327Q
L328E
P329K
A330L
A330S/P331S
I332K
I332R
V266D/A327Q
V266D/P329K
S267R/A327Q
S267R/P329K
G236R/L328R
E233P/L234V/L235A/G236_/S239K
E233P/L234V/L235A/G236_/S267K
E233P/L234V/L235A/G236_/S239K/A327G
E233P/L234V/L235A/G236_/S267K/A327G
E233P/L234V/L235A/G236_
S239K/S267K
267K/P329K

Figures 6A-6E

| Figure s 6A | |
|---|---|
| IL-15-Fc monomer (-) | IL-15Rα(sushi)-Fc monomer (+) |
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

| Figure s 6B | |
|---|---|
| scIL-15/Rα-Fc monomer (-) | empty-Fc monomer (+) |
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

| Figure s 6C | |
|---|---|
| empty-Fc monomer (-) | IL-15Rα(sushi)-Fc monomer (+) |
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

| Figure s 6D | |
|---|---|
| IL-15Rα(sushi)-Fc Chain 1 | IL-15Rα(sushi)-Fc Chain 2 |
| C220S | C220S |
| FcKO E233P/L234V/L235A/G236_/S267K | FcKO E233P/L234V/L235A/G236_/S267K |
| ±M428L/N434S | ±M428L/N434S |

| Figure s 6E | |
|---|---|
| Fc-IL-15Rα(sushi) (-) | empty-Fc monomer (+) |
| C220S | C220S |
| Heterodimer pI variants L368D/K370S | Heterodimer pI variants S364K/E357Q |
| | Isosteric pI substitutions P217R/P228R/N276K |
| FcKO E233P/L234V/L235A/G236_/S267K | FcKO E233P/L234V/L235A/G236_/S267K |
| ±M428L/N434S | ±M428L/N434S |

Figure 7

| Name | Sequence | SEQ ID NO: |
|---|---|---|
| (GGGGS)$_1$ or GGGGS | GGGGS | 14 |
| (GGGGS)$_2$ | GGGGSGGGGS | 15 |
| (GGGGS)$_3$ | GGGGSGGGGSGGGGS | 16 |
| (GGGGS)$_4$ | GGGGSGGGGSGGGGSGGGGS | 17 |
| (GGGGS)$_5$ | GGGGSGGGGSGGGGSGGGGSGGGGS | 18 |
| (GGGGS)$_6$ | GGGGSGGGGSGGGGSGGGGSGGGGSGGGGS | 19 |
| (GGGGS)$_7$ | GGGGSGGGGSGGGGSGGGGSGGGGSGGGGSGGGGS | 20 |
| 30AA-linker | DPALVHQRPAPPGGGGSGGGGSGGGGSGGG | 21 |
| (GKPGS)$_1$ or GKPGS | GKPGS | 22 |
| (GKPGS)$_5$ | GKPGSGKPGSGKPGSGKPGSGKPGS | 23 |
| (GKPGS)$_6$ | GKPGSGKPGSGKPGSGKPGSGKPGSGKPGS | 24 |
| (GGGES)$_1$ or GGGES | GGGES | 25 |

Figure 8A

IL-15/Rα-Fc Backbone 1

>IL-15/Rα-Fc monomer 1 (SEQ ID NO: 26)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK >IL-15/Rα-Fc monomer 2 (SEQ ID NO: 27)
EPKSSDKTHTCPPCPAPPVAGPSVFLFPPKPKDTLMISRTPEVTCVVVDVKHEDPEVKFNWYVDGVEV
HNAKTKPREEEYNSTYRVVSVLTVLHQDWLNGKEYKCKVSNKALPAPIEKTISKAKGQPREPQVYTLP
PSREEMTKNQVSLTCDVSGFYPSDIAVEWESDGQPENNYKTTPPVLDSDGSFFLYSKLTVDKSRWEQG
DVFSCSVMHEALHNHYTQKSLSLSPGK

IL-15/Rα-Fc Backbone 2

>IL-15/Rα-Fc monomer 1 (SEQ ID NO: 28)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREEMTKNQVKLTCLVKGFYPSDIAVEWESNGQPENNYKTTPPVLDSDGSFFLYSKLTVDKSRWQQG
NVFSCSVMHEALHNHYTQKSLSLSPGK >IL-15/Rα-Fc monomer 2 (SEQ ID NO: 29)
EPKSSDKTHTCPPCPAPPVAGPSVFLFPPKPKDTLMISRTPEVTCVVVDVKHEDPEVKFNWYVDGVEV
HNAKTKPREEEYNSTYRVVSVLTVLHQDWLNGKEYKCKVSNKALPAPIEKTISKAKGQPREPQVYTLP
PSREEMTKNQVSLTCDVSGFYPSDIAVEWESDGQPENNYKTTPPVLDSDGSFFLYSKLTVDKSRWEQG
DVFSCSVMHEALHNHYTQKSLSLSPGK

IL-15/Rα-Fc Backbone 3

>IL-15/Rα-Fc monomer 1 (SEQ ID NO: 30)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREEMTKNQVKLTCLVKGFYPSDIAVEWESNGQPENNYKTTPPVLDSDGSFFLYSKLTVDKSRWQQG
NVFSCSVMHEALHNHYTQKSLSLSPGK >IL-15/Rα-Fc monomer 2 (SEQ ID NO: 31)
EPKSSDKTHTCPPCPAPPVAGPSVFLFPPKPKDTLMISRTPEVTCVVVDVKHEDPEVKFNWYVDGVEV
HNAKTKPREEEYNSTYRVVSVLTVLHQDWLNGKEYKCKVSNKALPAPIEKTISKAKGQPREPQVYTLP
PSREEMTKNQVSLTCEVSGFYPSDIAVEWESDGQPENNYKTTPPVLDSDGSFFLYSKLTVDKSRWEQG
DVFSCSVMHEALHNHYTQKSLSLSPGK

Figure 8B

IL-15/Rα-Fc Backbone 4

>IL-15/Rα-Fc monomer 1 (SEQ ID NO: 32)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSKGSFFLYSKLTVDKSRWQQG
NVFSCSVMHEALHNHYTQKSLSLSPGK >IL-15/Rα-Fc monomer 2 (SEQ ID NO: 33)
EPKSSDKTHTCPPCPAPPVAGPSVFLFPPKPKDTLMISRTPEVTCVVVDVKHEDPEVKFNWYVDGVEV
HNAKTKPREEEYNSTYRVVSVLTVLHQDWLNGKEYKCKVSNKALPAPIEKTISKAKGQPREPQVYTLP
PSREEMTENEVSLTCLVKGFYPSDIAVEWESDGQPENNYKTTPPVLDSDGSFFLYSKLEVDKSRWEQG
DVFSCSVMHEALHNHYTQKSLSLSPGK

IL-15/Rα-Fc Backbone 5

>IL-15/Rα-Fc monomer 1 (SEQ ID NO: 34)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSRDQLTKNQVKLTCLVKGFYPSDIAVEWESNGQPENNYKTTPPVLDSDGSFFLYSKLTVDKSRWQQG
NVFSCSVMHEALHNHYTQKSLSLSPGK >IL-15/Rα-Fc monomer 2 (SEQ ID NO: 35)
EPKSSDKTHTCPPCPAPPVAGPSVFLFPPKPKDTLMISRTPEVTCVVVDVKHEDPEVKFNWYVDGVEV
HNAKTKPREEEYNSTYRVVSVLTVLHQDWLNGKEYKCKVSNKALPAPIEKTISKAKGQPREPQVYTLP
PSRDELTKNQVSLTCDVSGFYPSDIAVEWESDGQPENNYKTTPPVLDSDGSFFLYSKLTVDKSRWEQG
DVFSCSVMHEALHNHYTQKSLSLSPGK

IL-15/Rα-Fc Backbone 6

>IL-15/Rα-Fc monomer 1 (SEQ ID NO: 36)
EPKSSDKTHTCPPCPAPPVAGPSVFLFPPKPKDTLMISRTPEVTCVVVDVKHEDPEVKFNWYVDGVEV
HNAKTKPREEQYASTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK >IL-15/Rα-Fc monomer 2 (SEQ ID NO: 37)
EPKSSDKTHTCPPCPAPPVAGPSVFLFPPKPKDTLMISRTPEVTCVVVDVKHEDPEVKFNWYVDGVEV
HNAKTKPREEEYASTYRVVSVLTVLHQDWLNGKEYKCKVSNKALPAPIEKTISKAKGQPREPQVYTLP
PSREEMTKNQVSLTCDVSGFYPSDIAVEWESDGQPENNYKTTPPVLDSDGSFFLYSKLTVDKSRWEQG
DVFSCSVMHEALHNHYTQKSLSLSPGK

Figure 8C

IL-15/Rα-Fc Backbone 7

>IL-15/Rα-Fc monomer 1 (SEQ ID NO: 38)
EPKSSDKTHTCPPCPAPPVAGPSVFLFPPKPKDTLMISRTPEVTCVVVDVKHEDPEVKFNWYVDGVEV
HNAKTKPREEQYSSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK

>IL-15/Rα-Fc monomer 2 (SEQ ID NO: 39)
EPKSSDKTHTCPPCPAPPVAGPSVFLFPPKPKDTLMISRTPEVTCVVVDVKHEDPEVKFNWYVDGVEV
HNAKTKPREEEYSSTYRVVSVLTVLHQDWLNGKEYKCKVSNKALPAPIEKTISKAKGQPREPQVYTLP
PSREEMTKNQVSLTCDVSGFYPSDIAVEWESDGQPENNYKTTPPVLDSDGSFFLYSKLTVDKSRWEQG
DVFSCSVMHEALHNHYTQKSLSLSPGK

IL-15/Rα-Fc Backbone 8

>IL-15/Rα-Fc monomer 1 (SEQ ID NO: 40)
ESKYGPPCPPCPAPEFLGGPSVFLFPPKPKDTLMISRTPEVTCVVVDVSQEDPEVQFNWYVDGVEVHN
AKTKPREEQFNSTYRVVSVLTVLHQDWLNGKEYKCKVSNKGLPSSIEKTISKAKGQPREPQVYTLPPS
QEQMTKNQVKLTCLVKGFYPSDIAVEWESNGQPENNYKTTPPVLDSDGSFFLYSRLTVDKSRWQEGNV
FSCSVMHEALHNHYTQKSLSLSLGK

>IL-15/Rα-Fc monomer 2 (SEQ ID NO: 41)
ESKYGPPCPPCPAPEFLGGPSVFLFPPKPKDTLMISRTPEVTCVVVDVSQEDPEVQFNWYVDGVEVHN
AKTKPREEEFNSTYRVVSVLTVLHQDWLNGKEYKCKVSNKGLPSSIEKTISKAKGQPREPQVYTLPPS
QEEMTKNQVSLTCDVSGFYPSDIAVEWESDGQPENNYKTTPPVLDSDGSFFLYSRLTVDKSRWEEGDV
FSCSVMHEALHNHYTQKSLSLSLGK

IL-15/Rα-Fc Backbone 9

>IL-15/Rα-Fc monomer 1 (SEQ ID NO: 42)
ERKCCVECPPCPAPPVAGPSVFLFPPKPKDTLMISRTPEVTCVVVDVSHEDPEVQFNWYVDGVEVHNA
KTKPREEQFNSTFRVVSVLTVVHQDWLNGKEYKCKVSNKGLPAPIEKTISKTKGQPREPQVYTLPPSR
EQMTKNQVKLTCLVKGFYPSDIAVEWESNGQPENNYKTTPPMLDSDGSFFLYSKLTVDKSRWQQGNVF
SCSVMHEALHNHYTQKSLSLSPGK

>IL-15/Rα-Fc monomer 2 (SEQ ID NO: 43)
ERKCCVECPPCPAPPVAGPSVFLFPPKPKDTLMISRTPEVTCVVVDVSHEDPEVQFNWYVDGVEVHNA
KTKPREEEFNSTFRVVSVLTVVHQDWLNGKEYKCKVSNKGLPAPIEKTISKTKGQPREPQVYTLPPSR
EEMTKNQVSLTCDVSGFYPSDIAVEWESDGQPENNYKTTPPMLDSDGSFFLYSKLTVDKSRWEQGDVF
SCSVMHEALHNHYTQKSLSLSPGK

Figure 8D

IL-15/Rα-Fc Backbone 10

>IL-15/Rα-Fc monomer 1 (SEQ ID NO: 44)
ERKCCVECPPCPAPPVAGPSVFLFPPKPKDTLMISRTPEVTCVVVDVKHEDPEVQFNWYVDGVEVHNA
KTKPREEQFNSTFRVVSVLTVVHQDWLNGKEYKCKVSNKGLPAPIEKTISKTKGQPREPQVYTLPPSR
EQMTKNQVKLTCLVKGFYPSDIAVEWESNGQPENNYKTTPPMLDSDGSFFLYSKLTVDKSRWQQGNVF
SCSVMHEALHNHYTQKSLSLSPGK >IL-15/Rα-Fc monomer 2 (SEQ ID NO: 45)
ERKCCVECPPCPAPPVAGPSVFLFPPKPKDTLMISRTPEVTCVVVDVKHEDPEVQFNWYVDGVEVHNA
KTKPREEEFNSTFRVVSVLTVVHQDWLNGKEYKCKVSNKGLPAPIEKTISKTKGQPREPQVYTLPPSR
EEMTKNQVSLTCDVSGFYPSDIAVEWESDGQPENNYKTTPPMLDSDGSFFLYSKLTVDKSRWEQGDVF
SCSVMHEALHNHYTQKSLSLSPGK

IL-15/Rα-Fc Backbone 11

>IL-15/Rα-Fc monomer 1 (SEQ ID NO: 46)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVLHEALHSHYTQKSLSLSPGK >IL-15/Rα-Fc monomer 2 (SEQ ID NO: 47)
EPKSSDKTHTCPPCPAPPVAGPSVFLFPPKPKDTLMISRTPEVTCVVVDVKHEDPEVKFNWYVDGVEV
HNAKTKPREEEYNSTYRVVSVLTVLHQDWLNGKEYKCKVSNKALPAPIEKTISKAKGQPREPQVYTLP
PSREEMTKNQVSLTCDVSGFYPSDIAVEWESDGQPENNYKTTPPVLDSDGSFFLYSKLTVDKSRWEQG
DVFSCSVLHEALHSHYTQKSLSLSPGK

IL-15/Rα-Fc Backbone 12

>IL-15/Rα-Fc monomer 1 (SEQ ID NO: 48)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSDGSFFLYSKLTVDKSRWQQG
NVFSCSVMHEALHNHYTQKSLSLSPGK >IL-15/Rα-Fc monomer 2 (SEQ ID NO: 49)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSDGSFFLYSKLTVDKSRWQQG
NVFSCSVMHEALHNHYTQKSLSLSPGK

Figure 8E

IL-15/Rα-Fc Backbone 13

>IL-15/Rα-Fc monomer 1 (SEQ ID NO: 50)
EPKSSDKTHTCPPCPAPPVAGPSVFLFPPKPKDTLMISRTPEVTCVVVDVKHEDPEVKFNWYVDGVEV
HNAKTKPREEEYNSTYRVVSVLTVLHQDWLNGKEYKCKVSNKALPAPIEKTISKAKGQPREPQVYTLP
PSREEMTKNQVSLTCDVSGFYPSDIAVEWESDGQPENNYKTTPPVLDSDGSFFLYSKLTVDKSRWEQG
DVFSCSVMHEALHNHYTQKSLSLSPGK

>IL-15/Rα-Fc monomer 2 (SEQ ID NO: 51)
ERKSSDKTHTCPRCPAPPVAGPSVFLFPPKPKDTLMISRTPEVTCVVVDVKHEDPEVKFKWYVDGVEV
HNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK

IL-15/Rα-heteroFc
Example: XENP20818 scIL-15/Rα-Fc
Example: XENP21478 ncIL-15/Rα-Fc
Example: XENP21479

Bivalent ncIL-15/Rα-Fc
Example: XENP21978

Bivalent scIL-15/Rα-Fc

Fc-ncIL-15/Rα
Example: XENP22637

Fc-scIL-15/Rα

Figure 10

>XENP20818 – human IL15-(GGGGS)₁ x human IL15Rα(Sushi)-(GGGGS)₁ Fc heterodimer

Chain 1 - human_IL15_(GGGGS)₁_Fc(216)_IgG1_pI(-)_Isosteric_A_C220S/PVA_/S267K/L368D/K370S (15902) (SEQ ID NOS 52-54)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Chain 2 - human_IL15Rα(Sushi)_(GGGGS)₁_Fc(216)_IgG1_C220S/PVA_/S267K/S364K/E357Q (15908) (SEQ ID NOS 55-57)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP21475 – human IL15 x human IL15Rα(Sushi) Fc heterodimer

Chain 1 - human_IL15-Fc(216)_IgG1_pI(-)_Isosteric_A_C220S/PVA_/S267K/L368D/K370S (16479) (SEQ ID NOS 58-60)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK

Chain 2 - human_IL15Rα(Sushi)-Fc(216)_IgG1_C220S/PVA_/S267K/S364K/E357Q (16481) (SEQ ID NOS 61-63)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 11

>XENP21478 – human IL15Rα(Sushi)-(GGGGS)₆-human IL15(single-chain) Fc heterodimer Chain 1 - human_IL15Rα(sushi)_(GGGGS)₆-human_IL15-Fc(216)_IgG1_pI(-
)_Isosteric_A_C220S/PVA_/S267K/L368D/K370S (16478) (SEQ ID NOS 64-67)
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGS/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVQMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK Chain 2 - empty-Fc(216)_IgG1_C220S/PVA_/S267K/S364K/E357Q (8924) (SEQ ID NO: 68)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 12A

>XENP21479 – empty-Fc-IL15(non-covalent)-human_IL15Rα(Sushi) Fc heterodimer

Chain 1 - human_IL15_no_tag (16484) (SEQ ID NO: 69)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS Chain 2 - empty-Fc(216)_IgG1_pI(-)_Isosteric_A_C220S/PVA_/S267K/L368D/K370S (8793) (SEQ ID NO: 70)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 3 - human_IL15Rα(Sushi)-Fc(216)_IgG1_C220S/PVA_/S267K/S364K/E357Q (16481) (SEQ ID NOS 71-73)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP022366 – empty-Fc-IL15(non-covalent)-human_IL15Ra(sushi)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_no_tag (16484) (SEQ ID NO: 74)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS Chain 2 - empty-Fc(216)_IgG1_pI(-)_Isosteric_A_C220S/PVA_/S267K/L368D/K370S (8793) (SEQ ID NO: 75)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 3 - human_IL15Ra(Sushi)_(GGGGS)1_Fc(216)_IgG1_C220S/PVA_/S267K/S364K/E357Q (15908) (SEQ ID NOS 76-78)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 12B

>XENP024348 IL15(non-covalent)-human_IL15Ra(Sushi)_empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 – IL15 WT (SEQ ID NO: 79)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS Chain 2 – human_IL15Ra(Sushi)_Fc(216)_IgG1_pI(-)_Isosteric_A_C220S/PVA_/S267K/L368D/K370S (SEQ ID NOS 80-82)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK Chain 3 – empty_Fc(216)_IgG1_C220S/PVA_/S267K/S364K/E357Q (SEQ ID NO: 83)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 13

>XENP021978 – human_IL15(non-covalent)-human_IL15Ra(Sushi)_Fc(216)_IgG1_C220S/PVA_/S267K

Chain 1 - human_IL15Ra(Sushi)-Fc(216)_IgG1_C220S/PVA_/S267K (17023) (SEQ ID NOS 84-86)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK Chain 2 - human_IL15_no_tag (16484) (SEQ ID NO: 87)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Figure 14 human_IL15Ra(sushi)(single-chain)-human_IL15_Fc(216)_IgG1_C220S/PVA_/S267K (SEQ ID NOS 88-91)

ITCPPPMSVEHADIWVKSYSLYSRERYICNSGFKRKAGTSSLTECVLNKATNVAHWTTPSLKCIR/GGGGS/NWV
NVISDLKKIEDLIQSMHIDATLYTESDVHPSCKVTAMKCFLLELQVISLESGDASIHDTVENLIILANNSLSSNG
NVTESGCKECEELEEKNIKEFLQSFVHIVQMFINTS/EPKSSDKTHTCPPCPAPPVAGPSVFLFPPKPKDTLMIS
RTPEVTCVVVDVKHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK

Figure 15

>XENP022637 – empty-Fc(216)_IgG1_pI(-
)_Isosteric_A_C220S/PVA_/S267K/L368D/K370S_(GGGGS)2_IL15Ra(Sushi)_IL15(non-covalent)_IgG1_ISO(+RR)_C220S/PVA_/S267K/S364K/E357Q Chain 1 - empty- Figure 15

Fc(216)_IgG1_pI(-)_Isosteric_A_C220S/PVA_/S267K/L368D/K370S_(GGGGS)2_IL15Ra(Sushi) (17603) (SEQ ID NOS 92-94)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIR Chain 2 - empty-Fc(216)_IgG1_ISO(+RR)_C220S/PVA_/S267K/S364K/E357Q (8927) (SEQ ID NO: 95)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK Chain 3 - human_IL15_no_tag (16484) (SEQ ID NO: 96)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Figure 16 empty-Fc(216)_IgG1_pI(-
)_Isosteric_A_C220S/PVA_/S267K/L368D/K370S_(GGGGS)2_IL15Ra(Sushi)_IL15(single-
chain)_IgG1_ISO(+RR)_C220S/PVA_/S267K/S364K/E357Q Chain 1 - empty-Fc(216)_IgG1_pI(-
)_Isosteric_A_C220S/PVA_/S267K/L368D/K370S_(GGGGS)2_IL15Ra(Sushi)_IL15(single-chain) (SEQ ID NOS 97-100)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIR/GGGGS/NWVNVISDLKKIEDLIQSMHIDATLYTESDVHPSCKVTAMKCFLLELQVISLESGDASIH
DTVENLIILANNSLSSNGNVTESGCKECEELEEKNIKEFLQSFVHIVQMFINTS Chain 2 - empty-Fc(216)_IgG1_ISO(+RR)_C220S/PVA_/S267K/S364K/E357Q (8927) (SEQ ID NO: 101)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

XENP20818 pI(MW) = 6.41 (72.7 kDa)
Protein A yield = 25.7 mg/L

Octet Red 96 – AHC capture of XENP20818; dip in 200 nM, 40 nM, or 8 nM IL2-Rβ (R&D systems); KD ~ 3 nM

XENP21478 pI(MW) = 6.41 (74.0 kDa)
Protein A yield = 68.1 mg/L

Octet Red 96 – AHC capture of XENP21478; dip in 200 nM, 40 nM, or 8 nM IL2Rβ (R&D systems); KD ~ 3 nM pI(MW) = 6.41 (72.1 kDa)
Protein A yield = 57.1 mg/L Octet Red 96 – AHC capture of XENP21479; dip in 200 nM, 40 nM, or 8 nM IL2Rβ (R&D systems); KD ~ 3 nM

Figure 27

IL-15Rα(sushi-D96) (SEQ ID NO: 102)
ITCPPPMSVEHADIWVKSYSLYSRERYICNSGFKRKAGTSSLTECVLNKATNVAHWTTPSLKCIRD IL-15Rα(sushi-D96/P97) (SEQ ID NO: 103)
ITCPPPMSVEHADIWVKSYSLYSRERYICNSGFKRKAGTSSLTECVLNKATNVAHWTTPSLKCIRDP IL-15Rα(sushi-D96/P97/A98) (SEQ ID NO: 104)
ITCPPPMSVEHADIWVKSYSLYSRERYICNSGFKRKAGTSSLTECVLNKATNVAHWTTPSLKCIRDPA

Figure 28

IL-15(E87C) (SEQ ID NO: 105)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

IL-15(V49C) (SEQ ID NO: 106)
NWVNVISDLKKIEDLIQSMHIDATLYTESDVHPSCKVTAMKCFLLELQCISLESGDASIHDTVENLIILANNSLS
SNGNVTESGCKECEELEEKNIKEFLQSFVHIVQMFINTS

IL-15(L52C) (SEQ ID NO: 107)
NWVNVISDLKKIEDLIQSMHIDATLYTESDVHPSCKVTAMKCFLLELQVISCESGDASIHDTVENLIILANNSLS
SNGNVTESGCKECEELEEKNIKEFLQSFVHIVQMFINTS

IL-15(E89C) (SEQ ID NO: 108)
NWVNVISDLKKIEDLIQSMHIDATLYTESDVHPSCKVTAMKCFLLELQVISLESGDASIHDTVENLIILANNSLS
SNGNVTESGCKECCELEEKNIKEFLQSFVHIVQMFINTS

IL-15(Q48C) (SEQ ID NO: 109)
NWVNVISDLKKIEDLIQSMHIDATLYTESDVHPSCKVTAMKCFLLELCVISLESGDASIHDTVENLIILANNSLS
SNGNVTESGCKECEELEEKNIKEFLQSFVHIVQMFINTS

IL-15(E53C) (SEQ ID NO: 110)
NWVNVISDLKKIEDLIQSMHIDATLYTESDVHPSCKVTAMKCFLLELQVISLCSGDASIHDTVENLIILANNSLS
SNGNVTESGCKECEELEEKNIKEFLQSFVHIVQMFINTS

IL-15(C42S) (SEQ ID NO: 111)
NWVNVISDLKKIEDLIQSMHIDATLYTESDVHPSCKVTAMKSFLLELQVISLESGDASIHDTVENLIILANNSLS
SNGNVTESGCKECEELEEKNIKEFLQSFVHIVQMFINTS

IL-15(L45C) (SEQ ID NO: 112)
NWVNVISDLKKIEDLIQSMHIDATLYTESDVHPSCKVTAMKCFLCELQVISLESGDASIHDTVENLIILANNSLS
SNGNVTESGCKECEELEEKNIKEFLQSFVHIVQMFINTS

Figure 29

IL-15Rα(sushi-D96/C97) (SEQ ID NO: 113)
ITCPPPMSVEHADIWVKSYSLYSRERYICNSGFKRKAGTSSLTECVLNKATNVAHWTTPSLKCIRDC

IL-15Rα(sushi-D96/P97/C98) (SEQ ID NO: 114)
ITCPPPMSVEHADIWVKSYSLYSRERYICNSGFKRKAGTSSLTECVLNKATNVAHWTTPSLKCIRDPC

IL-15Rα(sushi-D96/C97/A98) (SEQ ID NO: 115)
ITCPPPMSVEHADIWVKSYSLYSRERYICNSGFKRKAGTSSLTECVLNKATNVAHWTTPSLKCIRDCA

IL-15Rα(sushi-S40C) (SEQ ID NO: 116)
ITCPPPMSVEHADIWVKSYSLYSRERYICNSGFKRKAGTCSLTECVLNKATNVAHWTTPSLKCIR

IL-15Rα(sushi-K34C) (SEQ ID NO: 117)
ITCPPPMSVEHADIWVKSYSLYSRERYICNSGFCRKAGTSSLTECVLNKATNVAHWTTPSLKCIR

IL-15Rα(sushi-G38C) (SEQ ID NO: 118)
ITCPPPMSVEHADIWVKSYSLYSRERYICNSGFKRKACTSSLTECVLNKATNVAHWTTPSLKCIR

IL-15Rα(sushi-L42C) (SEQ ID NO: 119)
ITCPPPMSVEHADIWVKSYSLYSRERYICNSGFKRKAGTSSCTECVLNKATNVAHWTTPSLKCIR

IL-15Rα(sushi-A37C) (SEQ ID NO: 120)
ITCPPPMSVEHADIWVKSYSLYSRERYICNSGFKRKCGTSSLTECVLNKATNVAHWTTPSLKCIR ncIL-15/Rα Heterodimer
Example: XENP21996 dsIL-15/Rα Heterodimer
Example: XENP22004 scIL-15/Rα Heterodimer
Example: XENP22049

Figure 31

>XENP021996 - human_IL15(non-covalent)-human_IL15Ra(Sushi)

Chain 1 - human_IL15_no_tag (16484) (SEQ ID NO: 121)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS Chain 2 - human_IL15Ra(Sushi) (17033) (SEQ ID NO: 122)
ITCPPPMSVEHADIWVKSYSLYSRERYICNSGFKRKAGTSSLTECVLNKATNVAHWTTPSLKCIR

Figure 32

>XENP022004 - human_IL15_E87C-human_IL15Ra(Sushi-D96/C97)

Chain 1 - human_IL15_E87C_no_tag (17074) (SEQ ID NO: 123)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS Chain 2 - human_IL15Ra(Sushi-D96/C97) (17051) (SEQ ID NO: 124)
ITCPPPMSVEHADIWVKSYSLYSRERYICNSGFKRKAGTSSLTECVLNKATNVAHWTTPSLKCIRDC >XENP022005 - human_IL15_E87C-human_IL15Ra(Sushi-D96/P97/C98)

Chain 1 - human_IL15_E87C_no_tag (17074) (SEQ ID NO: 125)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS Chain 2 - human_IL15Ra(Sushi-D96/P97/C98) (17052) (SEQ ID NO: 126)
ITCPPPMSVEHADIWVKSYSLYSRERYICNSGFKRKAGTSSLTECVLNKATNVAHWTTPSLKCIRDPC >XENP022006 - human_IL15_E87C-human_IL15Ra(Sushi-D96/C97/A98)

Chain 1 - human_IL15_E87C_no_tag (17074) (SEQ ID NO: 127)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS Chain 2 - human_IL15Ra(Sushi-D96/C97/A98) (17053) (SEQ ID NO: 128)
ITCPPPMSVEHADIWVKSYSLYSRERYICNSGFKRKAGTSSLTECVLNKATNVAHWTTPSLKCIRDCA >XENP022008 - human_IL15_L52C-human_IL15Ra(Sushi-S40C)

Chain 1 - human_IL15_L52C_no_tag (17072) (SEQ ID NO:
129)NWVNVISDLKKIEDLIQSMHIDATLYTESDVHPSCKVTAMKCFLLELQVISCESGDASIHDTVENLIILANN
SLSSNGNVTESGCKECEELEEKNIKEFLQSFVHIVQMFINTS Chain 2 - human_IL15Ra(Sushi-S40C) (17057) (SEQ ID NO: 130)
ITCPPPMSVEHADIWVKSYSLYSRERYICNSGFKRKAGTCSLTECVLNKATNVAHWTTPSLKCIR >XENP022494 – human_IL15_L45C-human_IL15Ra(Sushi-A37C)

Chain 1 - human_IL15_L45C_no_tag (17069) (SEQ ID NO: 131)
NWVNVISDLKKIEDLIQSMHIDATLYTESDVHPSCKVTAMKCFLCELQVISLESGDASIHDTVENLIILANNSLS
SNGNVTESGCKECEELEEKNIKEFLQSFVHIVQMFINTS Chain 2 - human_IL15Ra(Sushi-A37C) (17055) (SEQ ID NO: 132)
ITCPPPMSVEHADIWVKSYSLYSRERYICNSGFKRKCGTSSLTECVLNKATNVAHWTTPSLKCIR

Figure 33

>XENP022049 - human_IL15Ra(sushi)_(GGGGS)6-human_IL15-sc (SEQ ID NOS 133-135)

ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGS/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVQMFINTS

Figure 38

| XENP | Variant | Yield (mg/ml) | MW (g/mol) | Calculated ΔAffinity | $T_m$ (°C) | IL2Rß Affinity (~nM $K_D$) |
|---|---|---|---|---|---|---|
| 21996 | No Disulfide Control IL-15/Rα | 8.04 | 21079.9 | NA | 70.0 | 6.3 |
| 22001 | No Disulfide Control IL-15/Rα(D96) | 2.45 | 21195.0 | NA | 70.0 | 5.2 |
| 22002 | No Disulfide Control IL-15/Rα(D96/P97) | 2.47 | 21292.1 | NA | 72.0 | 7.4 |
| 22003 | No Disulfide Control IL-15/Rα(D96/P97/A98) | 3.48 | 21363.2 | NA | 72.5 | 5.7 |
| 22004 | IL-15(E87C)/Rα(D96/C97) | 4.58 | 21272.2 | -7.61 | 83.0 | 4.1 |
| 22005 | IL-15(E87C)/Rα(D96/C97/A98) | 8.4 | 21369.3 | NA | 83 (shoulder) | 6.1 |
| 22006 | IL-15(E87C)/Rα(D96/C97/A98) | 3.19 | 21343.2 | -7.61 | 83.0 | 5.1 |
| 22007 | IL-15(V49C)/Rα(S40C) | 1.58 | 21100.0 | 1.22 | 77.0 | 11 |
| 22008 | IL-15(L52C)/Rα(S40C) | 4.56 | 21085.9 | -0.97 | 82.5 | 17 |
| 22009 | IL-15(E89C)/Rα(K34C) | 0.51 | 21028.9 | -0.33 | 70.5 | 7.3 |
| 22010 | IL-15(Q48C)/Rα(G38C) | 0.42 | 21101.0 | 0.91 | 57.5 | 3.8 |
| 22011 | IL-15(E53C)/Rα(L42C) | 3.72 | 21043.9 | 3.73 | 76.0 | 17 |
| 22012 | IL-15(C42S)/Rα(A37C) | 0.44 | 21095.9 | NA | 75.0 | 5.3 |
| 22049 | Single-chain control | 5.77 | 22953.6 | NA | 73.0 | 22 |
| 22493 | IL-15(L45C)/Rα(G38C) | 0.40 | 21116.0 | 0.77 | 71.5 | NA |
| 22494 | IL-15(L45C)/Rα(A37C) | 3.63 | 21101.9 | 0.63 | 82.5 | NA | dsIL-15/Rα-heteroFc
Example: XENP22013 dsIL-15/Rα-Fc
Example: XENP22357

Bivalent dsIL-15/Rα-Fc
Example: XENP22634

Fc-dsIL-15/Rα
Example: XENP22639

Figure 40A

>XENP022013 human_IL15_E87C_(GGGGS)1-human_IL15Ra(Sushi-D96/C97)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_(GGGGS)1_Fc(216)_IgG1_pI(-)_Isosteric_A_C220S/PVA_/S267K/L368D/K370S (SEQ ID NOS 136-138)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK Chain 2 - human_IL15Ra(Sushi-D96/C97)_(GGGGS)1_Fc(216)_IgG1_C220S/PVA_/S267K/S364K/E357Q (SEQ ID NOS 139-141)
ITCPPPMSVEHADIWVKSYSLYSRERYICNSGFKRKAGTSSLTECVLNKATNVAHWTTPSLKCIRDC/GGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLTVLHQDWLNGKEYKCK
VSNKALPAPIEKTISKAKGQPREPQVYTLPPSREQMTKNQVKLTCLVKGFYPSDIAVEWESNGQPENNYKTTPPVLDSDGSFFLYSKLTV
DKSRWQQGNVFSCSVMHEALHNHYTQKSLSLSPGK

>XENP022014 human_IL15_E87C_(GGGGS)1-human_IL15Ra(Sushi-D96/P97/C98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_(GGGGS)1_Fc(216)_IgG1_pI(-)_Isosteric_A_C220S/PVA_/S267K/L368D/K370S (SEQ ID NOS 142-144)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK Chain 2 - human_IL15Ra(Sushi-D96/P97/C98)_(GGGGS)1_Fc(216)_IgG1_C220S/PVA_/S267K/S364K/E357Q (SEQ ID NOS 145-147)
ITCPPPMSVEHADIWVKSYSLYSRERYICNSGFKRKAGTSSLTECVLNKATNVAHWTTPSLKCIRDPC/GGGGS/EPKSSDKTHTCPPCP
APPVAGPSVFLFPPKPKDTLMISRTPEVTCVVVDVKHEDPEVKFNWYVDGVEVHNAKTKPREEQYNSTYRVVSVLTVLHQDWLNGKEYKC
KVSNKALPAPIEKTISKAKGQPREPQVYTLPPSREQMTKNQVKLTCLVKGFYPSDIAVEWESNGQPENNYKTTPPVLDSDGSFFLYSKLT
VDKSRWQQGNVFSCSVMHEALHNHYTQKSLSLSPGK

>XENP022015 human_IL15_E87C_(GGGGS)1-human_IL15Ra(Sushi-D96/C97/A98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_(GGGGS)1_Fc(216)_IgG1_pI(-)_Isosteric_A_C220S/PVA_/S267K/L368D/K370S (SEQ ID NOS 148-150)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK Chain 2 - human_IL15Ra(Sushi-D96/C97/A98)_(GGGGS)1_Fc(216)_IgG1_C220S/PVA_/S267K/S364K/E357Q (SEQ ID NOS 151-153)
ITCPPPMSVEHADIWVKSYSLYSRERYICNSGFKRKAGTSSLTECVLNKATNVAHWTTPSLKCIRDCA/GGGGS/EPKSSDKTHTCPPCP
APPVAGPSVFLFPPKPKDTLMISRTPEVTCVVVDVKHEDPEVKFNWYVDGVEVHNAKTKPREEQYNSTYRVVSVLTVLHQDWLNGKEYKC
KVSNKALPAPIEKTISKAKGQPREPQVYTLPPSREQMTKNQVKLTCLVKGFYPSDIAVEWESNGQPENNYKTTPPVLDSDGSFFLYSKLT
VDKSRWQQGNVFSCSVMHEALHNHYTQKSLSLSPGK

Figure 40B

>XENP022017 human_IL15_L52C_(GGGGS)1-human_IL15Ra(Sushi-S40C)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 – human_IL15_L52C_(GGGGS)1-_Fc(216)_IgG1_pI(-)_Isosteric_A_C220S/PVA_/S267K/L368D/K370S (SEQ ID NOS 154-156)

NWVNVISDLKKIEDLIQSMHIDATLYTESDVHPSCKVTAMKCFLLELQVISCESGDASIHDTVENLIILANNSLSSNGNVTESGCKECEELEEKNIKEFLQSFVHIVQMFINTS/GGGGS/EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

Chain 2 – human_IL15Ra(Sushi-S40C)_(GGGGS)1_Fc(216)_IgG1_C220S/PVA_/S267K/S364K/E357Q (SEQ ID NOS 157-159)

ITCPPPMSVEHADIWVKSYSLYSRERYICNSGFKRKAGTCSLTECVLNKATNVAHWTTPSLKCIR/GGGGS/EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

Figure 41A

>XENP022358 – empty-Fc-IL15_E87C-human_IL15Ra(Sushi-D96/P97/C98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_E87C_no_tag (17074) (SEQ ID NO: 160)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS Chain 2 - empty-Fc(216)_IgG1_pI(-)_Isosteric_A_C220S/PVA_/S267K/L368D/K370S (8793) (SEQ ID NO: 161)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 3 - human_IL15Ra(Sushi-D96/P97/C98)_(GGGGS)1_Fc(216)_IgG1_C220S/PVA_/S267K/S364K/E357Q (17039) (SEQ ID NOS 162-164)
ITCPPPMSVEHADIWVKSYSLYSRERYICNSGFKRKAGTSSLTECVLNKATNVAHWTTPSLKCIRDPC/GGGGS/
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP022359 – empty-Fc-IL15_E87C-human_IL15Ra(Sushi-D96/C97/A98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_E87C_no_tag (17074) (SEQ ID NO: 165)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS Chain 2 - empty-Fc(216)_IgG1_pI(-)_Isosteric_A_C220S/PVA_/S267K/L368D/K370S (8793) (SEQ ID NO: 166)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 3 - human_IL15Ra(Sushi-D96/C97/A98)_(GGGGS)1_Fc(216)_IgG1_C220S/PVA_/S267K/S364K/E357Q (17040) (SEQ ID NOS 167-169)
ITCPPPMSVEHADIWVKSYSLYSRERYICNSGFKRKAGTSSLTECVLNKATNVAHWTTPSLKCIRDCA/GGGGS/
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 41B

>XENP022361 – empty-Fc-IL15_L52C-human_IL15Ra(Sushi-S40C)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_L52_no_tag (17072) (SEQ ID NO: 170)
NWVNVISDLKKIEDLIQSMHIDATLYTESDVHPSCKVTAMKCFLLELQVISCESGDASIHDTVENLIILANNSLS
SNGNVTESGCKECEELEEKNIKEFLQSFVHIVQMFINTS

Chain 2 - empty-Fc(216)_IgG1_pI(-)_Isosteric_A_C220S/PVA_/S267K/L368D/K370S (8793) (SEQ ID NO: 171)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi-S40C)_(GGGGS)1_Fc(216)_IgG1_C220S/PVA_/S267K/S364K/E357Q (17044) (SEQ ID NOS 172-174)
ITCPPPMSVEHADIWVKSYSLYSRERYICNSGFKRKAGTCSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022684 empty-Fc-IL15_E87C-human_IL15Ra(Sushi-D96/C97/A98)_Fc(216)_IgG1_pI(-)_Isosteric_A_C220S/PVA_/S267K/L368D/K370S-Fc(216)_IgG1_C220S/PVA_/S267K/S364K/E357Q

Chain 1 – IL15_E87C (SEQ ID NO: 175)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS

Chain 2 - IL15Ra(Sushi-D96/C97/A98)_Fc(216)_IgG1_pI(-)_Isosteric_A_C220S/PVA_/S267K/L368D/K370S (SEQ ID NOS 176-178)
ITCPPPMSVEHADIWVKSYSLYSRERYICNSGFKRKAGTSSLTECVLNKATNVAHWTTPSLKCIRDCA/EPKSSDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLNGKEYKCKVSNKA
LPAPIEKTISKAKGQPREPQVYTLPPSREQMTKNQVKLTCLVKGFYPSDIAVEWESNGQPENNYKTTPPVLDSDGSFFLYSKLTVDKSRW
QQGNVFSCSVMHEALHNHYTQKSLSLSPGK

Figure 42

>XENP022634 – human_IL15(E87C)-human_IL15Ra(Sushi-D96/C97)_Fc(216)_IgG1_C220S/PVA_/S267K

Chain 1 - human_IL15Ra(Sushi-D96/C97)-Fc(216)_IgG1_C220S/PVA_/S267K (17581)
ITCPPPMSVEHADIWVKSYSLYSRERYICNSGFKRKAGTSSLTECVLNKATNVAHWTTPSLKCIRDC/EPKSSDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NOS 179-181)

Chain 2 - human_IL15_E87C_no_tag (17074) (SEQ ID NO: 182)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

>XENP022635 – human_IL15(E87C)-human_IL15Ra(Sushi-D96/C97/A98)_Fc(216)_IgG1_C220S/PVA_/S267K

Chain 1 - human_IL15Ra(Sushi-D96/C97/A98)-Fc(216)_IgG1_C220S/PVA_/S267K (17582) (SEQ ID NOS 183-185)
ITCPPPMSVEHADIWVKSYSLYSRERYICNSGFKRKAGTSSLTECVLNKATNVAHWTTPSLKCIRDCA/EPKSSD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK Chain 2 - human_IL15_E87C_no_tag (17074) (SEQ ID NO: 186)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

>XENP022636 – human_IL15(L52C)-human_IL15Ra(Sushi-S40C)_Fc(216)_IgG1_C220S/PVA_/S267K

Chain 1 - human_IL15Ra(Sushi-S40C)-Fc(216)_IgG1_C220S/PVA_/S267K (17583) (SEQ ID NOS 187-189)
ITCPPPMSVEHADIWVKSYSLYSRERYICNSGFKRKAGTCSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK Chain 2 - human_IL15_L52C_no_tag (17072) (SEQ ID NO: 190)
NWVNVISDLKKIEDLIQSMHIDATLYTESDVHPSCKVTAMKCFLLELQVISCESGDASIHDTVENLIILANNSLS
SNGNVTESGCKECEELEEKNIKEFLQSFVHIVQMFINTS

Figure 43

>XENP022639 – empty-Fc(216)_IgG1_pI(-
)_Isosteric_A_C220S/PVA_/S267K/L368D/K370S_(GGGGS)2_IL15Ra(Sushi-
D96/C97)_IL15(E87C)_IgG1_ISO(+RR)_C220S/PVA_/S267K/S364K/E357Q Chain 1 - empty-Fc(216)_IgG1_pI(-)_Isosteric_A_C220S/PVA_/S267K/L368D/K370S_(GGGGS)2_IL15Ra(Sushi-
D96/C97) (17605) (SEQ ID NOS 191-193)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWQEGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIRDC Chain 2 - empty-Fc(216)_IgG1_ISO(+RR)_C220S/PVA_/S267K/S364K/E357Q (8927) (SEQ ID NO: 194)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK Chain 3 - human_IL15_E87C_no_tag (17074) (SEQ ID NO: 195)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS >XENP022640 empty-Fc(216)_IgG1_pI(-
)_Isosteric_A_C220S/PVA_/S267K/L368D/K370S_IgG1_ISO(+RR)_C220S/PVA_/S267K/S364K/E357Q_(GGGGS
)2_IL15Ra(Sushi-D96/C97)_IL15(E87C)

Chain 1 – IL15 (SEQ ID NO: 196)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS Chain 2 – empty_Fc(216)_IgG1_pI(-)_Isosteric_A_C220S/PVA_/S267K/L368D/K370S (SEQ ID NO: 197)
EPKSSDKTHTCPPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDGQPENNYKTTPP
VLDSDGSFFLYSKLTVDKSRWQEGDVFSCSVMHEALHNHYTQKSLSLSPGK

Figure 47A

N1D (SEQ ID NO: 198)
DWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

N4D (SEQ ID NO: 199)
NWVDVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

D8N (SEQ ID NO: 200)
NWVNVISNLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

D30N (SEQ ID NO: 201)
NWVNVISDLKKIEDLIQSMHIDATLYTESNVHPSCKVTAMKCFLLELQVISLESGDASIHDTVENLIILANNSLSSNGNVTESGCKECEE
LEEKNIKEFLQSFVHIVQMFINTS

D61N (SEQ ID NO: 202)
NWVNVISDLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

E64Q (SEQ ID NO: 203)
NWVNVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

N65D (SEQ ID NO: 204)
NWVNVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

Q108E (SEQ ID NO: 205)
NWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVEMFINTS

N1D/D61N (SEQ ID NO: 206)
DWVNVISDLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

N1D/E64Q (SEQ ID NO: 207)
DWVNVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

N4D/D61N (SEQ ID NO: 208)
NWVDVISDLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

N4D/E64Q (SEQ ID NO: 209)
NWVDVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

Figure 47B

D8N/D61N (SEQ ID NO: 210)
NWVNVISNLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

D8N/E64Q (SEQ ID NO: 211)
NWVNVISNLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

D61N/E64Q (SEQ ID NO: 212)
NWVNVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVQMFINTS

E64Q/Q108E (SEQ ID NO: 213)
NWVNVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVEMFINTS

N1D/N4D/D8N (SEQ ID NO: 214)
DWVDVISNLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

D61N/E64Q/N65D (SEQ ID NO: 215)
NWVNVISDLKKIEDLIQSMHIDATLYTESDVHPSCKVTAMKCFLLELQVISLESGDASIHNTVQDLIILANNSLSSNGNVTESGCKECEE
LEEKNIKEFLQSFVHIVQMFINTS

N1D/D61N/E64Q/Q108E (SEQ ID NO: 216)
DWVNVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVEMFINTS

N4D/D61N/E64Q/Q108E (SEQ ID NO: 217)
NWVDVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVEMFINTS

N1D/N65D (SEQ ID NO: 218)
DWVNVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

N1D/Q108E (SEQ ID NO: 219)
DWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVEMFINTS

N4D/N65D (SEQ ID NO: 220)
NWVDVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

D30N/N65D (SEQ ID NO: 221)
NWVNVISDLKKIEDLIQSMHIDATLYTESNVHPSCKVTAMKCFLLELQVISLESGDASIHDTVEDLIILANNSLSSNGNVTESGCKECEE
LEEKNIKEFLQSFVHIVQMFINTS

D30N/Q108E (SEQ ID NO: 222)
NWVNVISDLKKIEDLIQSMHIDATLYTESNVHPSCKVTAMKCFLLELQVISLESGDASIHDTVENLIILANNSLSSNGNVTESGCKECEE
LEEKNIKEFLQSFVHIVEMFINTS

Figure 47C

N65D/Q108E (SEQ ID NO: 223)
NWVNVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVEMFINTS

E64Q/N65D (SEQ ID NO: 224)
NWVNVISDLKKIEDLIQSMHIDATLYTESDVHPSCKVTAMKCFLLELQVISLESGDASIHDTVQDLIILANNSLSSNGNVTESGCKECEE
LEEKNIKEFLQSFVHIVQMFINTS

N1D/N4D/N65D (SEQ ID NO: 225)
DWVDVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

D30N/E64Q/N65D (SEQ ID NO: 226)
NWVNVISDLKKIEDLIQSMHIDATLYTESNVHPSCKVTAMKCFLLELQVISLESGDASIHDTVQDLIILANNSLSSNGNVTESGCKECEE
LEEKNIKEFLQSFVHIVQMFINTS

N4D/D61N/N65D (SEQ ID NO: 227)
NWVDVISDLKKIEDLIQSMHIDATLYTESDVHPSCKVTAMKCFLLELQVISLESGDASIHNTVEDLIILANNSLSSNGNVTESGCKECEE
LEEKNIKEFLQSFVHIVQMFINTS

Figure 48A

>XENP022821 - human_IL15_N65D_(GGGGS)₁-human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_N65D_(GGGGS)₁ (17692) (SEQ ID NOS 228-230)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q (15908)
(SEQ ID NOS 231-233)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022822 - human_IL15_Q108E_(GGGGS)₁-human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_Q108E_(GGGGS)₁ (17693) (SEQ ID NOS 234-236)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q (15908)
(SEQ ID NOS 237-239)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP023554 - human_IL15_N1D/N65D_(GGGGS)1-human_IL15Ra(Sushi)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_N1D/N65D_(GGGGS)1_Fc(216)_IgG1_pI(-
)_Isosteric_A_C220S/PVA_/S267K/L368D/K370S (18783) (SEQ ID NOS 240-242)
DWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (15908) (SEQ ID
NOS 243-245)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 48B

>XENP023557 - human_IL15_N4D/N65D_(GGGGS)1-human_IL15Ra(Sushi)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_N4D/N65D_(GGGGS)1_Fc(216)_IgG1_pI(-
)_Isosteric_A_C220S/PVA_/S267K/L368D/K370S (18786) (SEQ ID NOS 246-248)
NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (15908) (SEQ ID
NOS 249-251)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP023561 human_IL15_N65D/Q108E_(GGGGS)1-human_IL15Ra(Sushi)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_N65D/Q108E_(GGGGS)1_Fc(216)_IgG1_pI(-
)_Isosteric_A_C220S/PVA_/S267K/L368D/K370S (SEQ ID NOS 252-254)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (SEQ ID NOS
255-257)
ITCPPPMSVEHADIWVKSYSLYSRERYICNSGFKRKAGTSSLTECVLNKATNVAHWTTPSLKCIR/GGGGS/EPKSSDKTHTCP
PCPAPPVAGPSVFLFPPKPKDTLMISRTPEVTCVVVDVKHEDPEVKFNWYVDGVEVHNAKTKPREEQYNSTYRVV
SVLTVLHQDWLNGKEYKCKVSNKALPAPIEKTISKAKGQPREPQVYTLPPSREQMTKNQVKLTCLVKGFYPSDIA
VEWESNGQPENNYKTTPPVLDSDGSFFLYSKLTVDKSRWQQGNVFSCSVMHEALHNHYTQKSLSLSPGK >XENP024018 human_IL15(N65D)-human_IL15Ra(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15(N65D)_Fc(216)_IgG1_pI(-)_Isosteric_A_C220S/PVA_/S267K/L368D/K370S (SEQ ID
NOS 258-260)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 - human_IL15Ra(Sushi)_Fc(216)_IgG1_C220S/PVA_/S267K/S364K/E357Q (SEQ ID NOS 261-263)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 48C

>XENP024019 - human_IL15(Q108E)-human_IL15Ra(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15(Q108E)-human_IL15Ra(Sushi)_Fc(216)_IgG1_pI(-
)_Isosteric_A_C220S/PVA_/S267K/L368D/K370S (19242) (SEQ ID NOS 264-266)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 - human_IL15Ra(Sushi)_Fc(216)_IgG1_C220S/PVA_/S267K/S364K/E357Q (16481) (SEQ ID NOS 267-
269)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP024045 human_IL15_D30N/E64Q/N65D_(GGGGS)1-
human_IL15Ra(Sushi)_(GGGGS)1_Fc(216)_IgG1_pI(-)_Isosteric_A_C220S/PVA_/S267K/L368D/K370S-
Fc(216)_IgG1_C220S/PVA_/S267K/S364K/E357Q Chain 1 – human_IL15_D30N/E64Q/N65D_(GGGGS)1_Fc(216)_IgG1_pI(-
)_Isosteric_A_C220S/PVA_/S267K/L368D/K370S (SEQ ID NOS 270-272)
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 – human_IL15Ra(Sushi)_(GGGGS)1_ Fc(216)_IgG1_C220S/PVA_/S267K/S364K/E357Q (SEQ ID NOS
273-275)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP024051 human_IL15_N1D/N65D-human_IL15Ra(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15_N1D/N65D-human_Fc(216)_IgG1_pI(-
)_Isosteric_A_C220S/PVA_/S267K/L368D/K370S (SEQ ID NOS 276-278)
DWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 – human_IL15Ra(Sushi)_ Fc(216)_IgG1_C220S/PVA_/S267K/S364K/E357Q (SEQ ID NOS 279-281)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 48D

>XENP024052 human_IL15_N4D/N65D-human_IL15Rα(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15_N4D/N65D-human_ Fc(216)_IgG1_pI(-
)_Isosteric_A_C220S/PVA_/S267K/L368D/K370S (SEQ ID NOS 282-284)
NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 – human_IL15Rα(Sushi)_Fc(216)_IgG1_C220S/PVA_/S267K/S364K/E357Q (SEQ ID NOS 285-287)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNRYTQKSLSLSPGK

Figure 49A

>XENP024015 human_IL15Ra(sushi)_(GGGGS)5-human_IL15(Q108E;single-chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)5-human_IL15(Q108E;single-chain)_Fc(216)_IgG1_pI(-
)_Isosteric_A_C220S/PVA_/S267K/L368D/K370S (SEQ ID NOS 288-291)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVEMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 292)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP024050 human_IL15Ra(sushi)_(GGGGS)5-human_IL15_N4D/N65D_(single-chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)5-human_IL15_N4D/N65D_(single-chain)_Fc(216)_IgG1_pI(-
)_Isosteric_A_C220S/PVA_/S267K/L368D/K370S (SEQ ID NOS 293-296)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 297)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 49B

>XENP024475 human_IL15Ra(sushi)_(GGGGS)6-human_IL15(single-chain;Q108E)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)6-human_IL15(single-chain;Q108E)_Fc(216)_IgG1_pI(-
)_Isosteric_A_C220S/PVA_/S267K/L368D/K370S (SEQ ID NOS 298-301)
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGS/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVEMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK Chain 2 – empty_ Fc(216)_IgG1_C220S/PVA_/S267K/S364K/E357Q (SEQ ID NO: 302)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP024476 human_IL15Ra(sushi)_(GGGGS)6-human_IL15(single-chain;N4D/N65D)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)6-human_IL15(single-chain;N4D/N65D)_Fc(216)_IgG1_pI(-
)_Isosteric_A_C220S/PVA_/S267K/L368D/K370S (SEQ ID NOS 303-306)
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGS/NWVDVISDLKKIEDLIQSMHIDATLYTESDVHPSCKVTAMKCFLLELQVISLE
SGDASIHDTVEDLIILANNSLSSNGNVTESGCKECEELEEKNIKEFLQSFVHIVQMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK Chain 2 – empty_ Fc(216)_IgG1_C220S/PVA_/S267K/S364K/E357Q (SEQ ID NO: 307)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP024478 human_IL15Ra(sushi)_(GGGGS)7-human_IL15(single-chain;Q108E)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)7-human_IL15(single-chain;Q108E)_Fc(216)_IgG1_pI(-
)_Isosteric_A_C220S/PVA_/S267K/L368D/K370S (SEQ ID NOS 308-311)
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGSGGGGS/NWVNVISDLKKIEDLIQSMHIDATLYTESDVHPSCKVTAMKCFLLELQ
VISLESGDASIHDTVENLIILANNSLSSNGNVTESGCKECEELEEKNIKEFLQSFVHIVEMFINTS/EPKSSDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK Chain 2 – empty_ Fc(216)_IgG1_C220S/PVA_/S267K/S364K/E357Q (SEQ ID NO: 312)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 49C

>XENP024479 human_IL15Ra(sushi)_(GGGGS)7-human_IL15(single-chain;N4D/N65D)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)7-human_IL15(single-chain;N4D/N65D)_Fc(216)_IgG1_pI(-
)_Isosteric_A_C220S/PVA_/S267K/L368D/K370S (SEQ ID NOS 313-316)
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGSGGGGS/NWVDVISDLKKIEDLIQSMHIDATLYTESDVHPSCKVTAMKCFLLELQ
VISLESGDASIHDTVEDLIILANNSLSSNGNVTESGCKECEELEEKNIKEFLQSFVHIVQMFINTS/EPKSSDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK Chain 2 - empty-Fc_Fc(216)_IgG1_C220S/PVA_/S267K/S364K/E357Q (SEQ ID NO: 317)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP024481 human_IL15Ra(sushi)_(30AA_linker_variant)-human_IL15(single-chain;Q108E)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(30AA_linker_variant)-human_IL15(single-chain;Q108E)_Fc(216)_IgG1_pI(-
)_Isosteric_A_C220S/PVA_/S267K/L368D/K370S (SEQ ID NOS 318-321)
ITCPPPMSVEHADIWVKSYSLYSRERYICNSGFKRKAGTSSLTECVLNKATNVAHWTTPSLKCIR/DPALVHQRP
APPGGGGSGGGGSGGGGSGGG/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVEMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 322)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 50A

>XENP024349 IL15_Q108E_(non-covalent)-human_IL15Rα(Sushi)_empty-Fc_Fc(216)_IgG1_pI(-
)_Isosteric_A_C220S/PVA_/S267K/L368D/K370S-Fc(216)_IgG1_C220S/PVA_/S267K/S364K/E357Q

Chain 1 – human_IL15Rα(Sushi)_ Isosteric_A_C220S/PVA_/S267K/L368D/K370S (SEQ ID NOS 323-325)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 2 – empty- Fc(216)_IgG1_C220S/PVA_/S267K/S364K/E357Q (SEQ ID NO: 326)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Chain 3 – IL15_Q108E_(non-covalent) (SEQ ID NO: 327)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS >XENP024890 IL15_N4D/N65D_(non-covalent)-human_IL15Rα(Sushi)-empty-Fc_IgG1_Fc(216)_IgG1_pI(-
)_Isosteric_A_C220S/PVA_/S267K/L368D/K370S-IgG1_PVA_/S267K/S364K/E357Q

Chain 1 – IL-15_N4D/N65D (SEQ ID NOS 328-330)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 2 - human_IL15Rα(Sushi)_Fc(216)_IgG1_pI(-)_Isosteric_A_C220S/PVA_/S267K/L368D/K370S (SEQ ID NOS 331-333)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 3 – empty_Fc(216)_ IgG1_PVA_/S267K/S364K/E357Q (SEQ ID NO: 334)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 50B

>XENP25138 IL15_D30N/E64Q/N65D_(non-covalent)-empty-Fc_Fc(216)_IgG1_pI(-)_Isosteric_A_C220S/PVA_/S267K/L368D/K370S-IgG1_PVA_/S267K/S364K/E357Q Chain 1 - IL15_D30N/E64Q/N65D (SEQ ID NO: 335)
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS Chain 2 - human_IL15Ra(Sushi)_Fc(216)_IgG1_pI(-)_Isosteric_A_C220S/PVA_/S267K/L368D/K370S (SEQ ID NOS 336-338)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK Chain 3 - empty_Fc(216)_IgG1_PVA_/S267K/S364K/E357Q (SEQ ID NO: 339)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 51

>XENP022801 - human_IL15_N65D(non-covalent)-human_IL15Rα(Sushi)

Chain 1 - human_IL15_N65D(non-covalent) (17672) (SEQ ID NO: 340)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS Chain 2 - human_IL15Rα(Sushi) (17033) (SEQ ID NO: 341)
ITCPPPMSVEHADIWVKSYSLYSRERYICNSGFKRKAGTSSLTECVLNKATNVAHWTTPSLKCIR

>XENP022802 - human_IL15_Q108E(non-covalent)-human_IL15Rα(Sushi)

Chain 1 - human_IL15_Q108E(non-covalent) (17673) (SEQ ID NO: 342)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS Chain 2 - human_IL15Rα(Sushi) (17033) (SEQ ID NO: 343)
ITCPPPMSVEHADIWVKSYSLYSRERYICNSGFKRKAGTSSLTECVLNKATNVAHWTTPSLKCIR

Figure 52

>XENP024342 human_IL15(non-covalent; Q108E)-human_IL15Rα(Sushi)_Fc(216)_IgG1_C220S/PVA_/S267K Chain 1 – human_IL15Rα(Sushi)_Fc(216)_IgG1_C220S/PVA_/S267K (SEQ ID NOS 344-346)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK Chain 2 –human_IL15(non-covalent; Q108E) (SEQ ID NO: 347)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS

Figure 53

>XENP023472 empty-Fc-IL15_N65D/E87C-human_IL15Ra(Sushi-D96/C97)_Fc(216)_IgG1_pI(-)_Isosteric_A_C220S/PVA_/S267K/L368D/K370S-Fc(216)_IgG1_C220S/PVA_/S267K/S364K/E357Q Chain 1 – empty_Fc(216)_IgG1_pI(-)_Isosteric_A_C220S/PVA_/S267K/L368D/K370S (SEQ ID NO: 348)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 2 - IL15_N65D/E87C (SEQ ID NO: 349)
NWVNVISDLKKIEDLIQSMHIDATLYTESDVHPSCKVTAMKCFLLELQVISLESGDASIHDTVEDLIILANNSLS
SNGNVTESGCKCCEELEEKNIKEFLQSFVHIVQMFINTS Chain 3 - IL15Ra(Sushi-D96/C97)_Fc(216)_IgG1_C220S/PVA_/S267K/S364K/E357Q (SEQ ID NOS 350-352)
ITCPPPMSVEHADIWVKSYSLYSRERYICNSGFKRKAGTSSLTECVLNKATNVAHWTTPSLKCIRDC/EPKSSDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK >XENP023473 empty-Fc-IL15_N65D/L52C-human_IL15Ra(Sushi-S40C)_Fc(216)_IgG1_pI(-)_Isosteric_A_C220S/PVA_/S267K/L368D/K370S-Fc(216)_IgG1_C220S/PVA_/S267K/S364K/E357Q Chain 1 – empty_Fc(216)_IgG1_pI(-)_Isosteric_A_C220S/PVA_/S267K/L368D/K370S (SEQ ID NO: 353)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 2 - IL15_N65D/L52C (SEQ ID NO: 354)
NWVNVISDLKKIEDLIQSMHIDATLYTESDVHPSCKVTAMKCFLLELQVISCESGDASIHDTVEDLIILANNSLS
SNGNVTESGCKECEELEEKNIKEFLQSFVHIVQMFINTS Chain 3 - IL15Ra(Sushi-S40C)_Fc(216)_IgG1_C220S/PVA_/S267K/S364K/E357Q (SEQ ID NOS 355-357)
ITCPPPMSVEHADIWVKSYSLYSRERYICNSGFKRKAGTCSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 55

| XENP | Variant | EC50 pM (NK cells) | Fold reduced (NK cells) | EC50 pM (CD8 T cells) | Fold reduced (CD8 T cells) |
|---|---|---|---|---|---|
| 20818 | WT | 200.6 | | 637.1 | |
| 21478 | single-chain | 848.5 | 4.2 | 4982.0 | 7.8 |
| 22815 | N1D | 281.3 | 1.4 | 1051.0 | 1.6 |
| 22816 | N4D | 321.9 | 1.6 | 1190.0 | 1.9 |
| 22817 | D8N | very weak | very weak | very weak | very weak |
| 22818 | D30N | 376.3 | 1.9 | 1366.0 | 2.1 |
| 22819 | D61N | 5934.0 | 29.6 | 161937.0 | >100 |
| 22820 | E64Q | 877.0 | 4.4 | 2858.0 | 4.5 |
| 22821 | N65D | 2883.0 | 14.4 | 6928.0 | 10.9 |
| 22822 | Q108E | 9777.0 | 48.7 | very weak | >100 |
| 22823 | N1D/D61N | 918.0 | 4.6 | 4225.0 | 6.6 |
| 22824 | N1D/E64Q | 1091.0 | 5.4 | 4228.0 | 6.6 |
| 22825 | N4D/D61N | 309.0 | 1.5 | 1070.0 | 1.7 |
| 22826 | N4D/E64Q | very weak | very weak | very weak | very weak |
| 22827 | D8N/D61N | ND | ND | ND | ND |
| 22828 | D8N/E64Q | 597.7 | 3.0 | 1658.0 | 2.6 |
| 22829 | D61N/E64Q | 458.2 | 2.3 | 2115.0 | 3.3 |
| 22830 | E64Q/Q108E | 436.6 | 2.2 | 1815.0 | 2.8 |
| 22831 | N1D/N4D/D8N | very weak | very weak | very weak | very weak |
| 22832 | D61N/E64Q/N65D | ND | ND | ND | ND |
| 22833 | N1D/D61N/E64Q/Q108E | ND | ND | ND | ND |
| 22834 | N4D/D61N/E64Q/Q108E | very weak | very weak | very weak | very weak |

Figure 59D

| XENP | EC50 nM (NK cells) | Fold reduced (NK cells) | EC50 nM (CD8 T cells) | Fold reduced (CD8 T cells) | EC50 nM (CD4 T cells) | Fold reduced (CD4 T cells) |
|---|---|---|---|---|---|---|
| 20818 | 0.3223 | 1.0 | 2.701 | 1.0 | 16.467 | 1.0 |
| 21478 | 1.116 | 3.5 | 11.728 | 4.3 | 28.349 | 1.7 |
| 22818 | 0.4205 | 1.3 | 2.829 | 1.0 | 40.676 | 2.5 |
| 22819 | 1.016 | 3.2 | 8.254 | 3.1 | 18.101 | 1.1 |
| 22820 | 0.562 | 1.7 | 3.918 | 1.5 | 10.362 | 0.6 |
| 22821 | 3.14 | 9.7 | 18.706 | 6.9 | 112.823 | 6.9 |
| 22822 | 68.866 | 213.7 | 6439.69 | 2384.2 | 48.738 | 3.0 |
| 22825 | 1.769 | 5.5 | 12.09 | 4.5 | 60.081 | 3.6 |
| 22826 | 1.448 | 4.5 | 9.678 | 3.6 | 22.41 | 1.4 |
| 22829 | 4.839 | 15.0 | 29.638 | 11.0 | 337.571 | 20.5 |
| 22834 | 331.293 | 1027.9 | 4107.897 | 1520.9 | ND | ND |
| IL-15 | 0.05322 | 0.2 | 0.3452 | 0.1 | ND | ND |

Figure 67C

| XENP | EC50 nM (CD8 T cells) | Fold reduced (CD8 T cells) | EC50 nM (CD4 T cells) | Fold reduced (CD4 T cells) |
|---|---|---|---|---|
| 22822 | 19.34 | 25.6 | 61.46 | 53.8 |
| 20818 | 0.7543 | 1.0 | 1.142 | 1.0 |
| 22821 | 5.196 | 6.9 | 8.485 | 7.4 |
| 22829 | 25.27 | 33.5 | 47.11 | 41.3 |
| 22834 | ND | ND | ND | ND |
| 23554 | 21.56 | 28.6 | 44.18 | 38.7 |
| 23555 | 270 | 357.9 | 818.2 | 716.5 |
| 23557 | 34.27 | 45.4 | 78.62 | 68.8 |
| 23559 | 32.91 | 43.6 | 76.03 | 66.6 |
| 24019 | 198.1 | 262.6 | 176.7 | 154.7 |
| 24020 | 15.92 | 21.1 | 30.98 | 27.1 |

Figure 94A

>XENP023343 - human_IL15_N65D_(GGGGS)1-human_IL15Ra(Sushi)_(GGGGS)1_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S Chain 1 - human_IL15_N65D_(GGGGS)1_Fc(216)_IgG1_pI(-
)_Isosteric_A_C220S/PVA_/S267K/L368D/K370S/M428L/N434S (18295) (SEQ ID NOS 358-360)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVLHEALHSHYTQKSLSLSPGK Chain 2 - human_IL15Ra(Sushi)_(GGGGS)1_Fc(216)_IgG1_C220S/PVA_/S267K/S364K/E357Q/M428L/N434S
(17761) (SEQ ID NOS 361-363)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK >XENP023504 human_IL15_Q108E_(GGGGS)1-human_IL15Ra(Sushi)_(GGGGS)1_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S Chain 1 – human_IL15_Q108E_(GGGGS)1_Fc(216)_IgG1_pI(-
)_Isosteric_A_C220S/PVA_/S267K/L368D/K370S/M428L/N434S (SEQ ID NOS 364-366)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVLHEALHSHYTQKSLSLSPGK Chain 2 – human_IL15Ra(Sushi)_(GGGGS)1_Fc(216)_IgG1_C220S/PVA_/S267K/S364K/E357Q/M428L/N434S
(SEQ ID NOS 367-369)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK

Figure 94B

>XENP024113 human_IL15_N4D/N65D_(GGGGS)1-human_IL15Rα(Sushi)_(GGGGS)1_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S Chain 1 – human_IL15_N4D/N65D_(GGGGS)1_Fc(216)_IgG1_pI(-
)_Isosteric_A_C220S/PVA_/S267K/L368D/K370S/M428L/N434S (SEQ ID NOS 370-372)
NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVLHEALHSHYTQKSLSLSPGK Chain 2 –human_IL15Rα(Sushi)_(GGGGS)1_Fc(216)_IgG1_C220S/PVA_/S267K/S364K/E357Q/M428L/N434S
(SEQ ID NOS 373-375)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK >XENP024301 human_IL15_N4D/N65D-human_IL15Rα(Sushi)_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S Chain 1 – human_IL15_N4D/N65D_Fc(216)_IgG1_pI(-
)_Isosteric_A_C220S/PVA_/S267K/L368D/K370S/M428L/N434S (SEQ ID NOS 376-378)
NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVLHEALHSHYTQKSLSLSPGK Chain 2 – human_IL15Rα(Sushi)_Fc(216)_IgG1_C220S/PVA_/S267K/S364K/E357Q/M428L/N434S (SEQ ID
NOS 379-381)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Figure 94C

>XENP024306 human_IL15_D30N/E64Q/N65D_(GGGGS)1-
human_IL15Rα(Sushi)_(GGGGS)1_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S Chain 1 – human_IL15_D30N/E64Q/N65D_(GGGGS)1_Fc(216)_IgG1_pI(-
)_Isosteric_A_C220S/PVA_/S267K/L368D/K370S/M428L/N434S (SEQ ID NOS 382-384)
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVLHEALHSHYTQKSLSLSPGK Chain 2 – human_IL15Rα(Sushi)_(GGGGS)1_Fc(216)_IgG1_C220S/PVA_/S267K/S364K/E357Q/M428L/N434S
(SEQ ID NOS 385-387)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK >XENP024341 human_IL15_N1D/N65D-human_IL15Rα(Sushi)_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S Chain 1 – human_IL15_N1D/N65D-human_Fc(216)_IgG1_pI(-
)_Isosteric_A_C220S/PVA_/S267K/L368D/K370S/M428L/N434S (SEQ ID NOS 388-390)
DWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVLHEALHSHYTQKSLSLSPGK Chain 2 – human_IL15Rα(Sushi)_Fc(216)_IgG1_C220S/PVA_/S267K/S364K/E357Q/M428L/N434S (SEQ ID
NOS 391-393)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Figure 94D

>XENP025938 human_IL15Ra(sushi)_(GGGGS)5-human_IL15_N4D/N65D_(single-chain)-empty-
Fc_Fc(216)_IgG1_pI(-)_Isosteric_A_C220S/PVA_/S267K/L368D/K370S/M428L/N434S-
Fc(216)_IgG1_C220S/PVA_/S267K/S364K/E357Q/M428L/N434S Chain 1 – human_IL15Ra(sushi)_(GGGGS)5-human_IL15_N4D/N65D_(single-chain)-_Fc(216)_IgG1_pI(-
)_Isosteric_A_C220S/PVA_/S267K/L368D/K370S/M428L/N434S (SEQ ID NOS 394-397)
ITCPPPMSVEHADIWVKSYSLYSRERYICNSGFKRKAGTSSLTECVLNKATNVAHWTTPSLKCIR/GGGGSGGGGSGGGGSGGGGSGGGG
S/NWVDVISDLKKIEDLIQSMHIDATLYTESDVHPSCKVTAMKCFLLELQVISLESGDASIHDTVEDLIIIANNSLSSNGNVTESGCKEC
EELEEKNIKEFLQSFVHIVQMFINTS/EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQPREPQVYTLPPSREEMTKNQVSLTCDV
SGFYPSDIAVEWESDGQPENNYKTTPPVLDSDGSFFLYSKLTVDKSRWEQGDVFSCSVLHEALHSHYTQKSLSLSPGK Chain 2 – empty_Fc(216)_IgG1_C220S/PVA_/S267K/S364K/E357Q/M428L/N434S (SEQ ID NO: 398)
EPKSSDKTHTCPPCPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWESNGQPENNYKTTPP
VLDSDGSFFLYSKLTVDKSRWQQGNVFSCSVLHEALHSHYTQKSLSLSPGK

Figure 95

>XENP024383 IL15_Q108E_(non-covalent)-human_IL15Ra(Sushi)_empty-Fc_Fc(216)_IgG1_pI(-)_Isosteric_A_C220S/PVA_/S267K/L368D/K370S/M428L/N434S-Fc(216)_IgG1_C220S/PVA_/S267K/S364K/E357Q/M428L/N434S Chain 1 - IL15_Q108E (SEQ ID NO: 399)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS Chain 2 - human_IL15Ra(Sushi)_Fc(216)_IgG1_pI(-)_Isosteric_A_C220S/PVA_/S267K/L368D/K370S/M428L/N434S (SEQ ID NOS 400-402)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVLHEALHSHYTQKSLSLSPGK Chain 3 – empty_ Fc(216)_IgG1_C220S/PVA_/S267K/S364K/E357Q/M428L/N434S (SEQ ID NO: 403)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVLHEALHSHYTQKSL
SLSPGK

Figure 96

>XENP024346 human_IL15(non-covalent; Q108E)-
human_IL15Rα(Sushi)_Fc(216)_IgG1_C220S/PVA_/S267K/M428L/N434S Chain 1 – human_IL15Rα(Sushi)_Fc(216)_IgG1_C220S/PVA_/S267K/M428L/N434S (SEQ ID NOS 404-406)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVLHEALHSHYTQKSLSLSPGK Chain 2 – human_IL15(non-covalent; Q108E) (SEQ ID NO: 407)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS >XENP024351 human_IL15(non-covalent; N4D/N65D)-
human_IL15Ra(Sushi)_Fc(216)_IgG1_C220S/PVA_/S267K/M428L/N434S Chain 1 – IL15(N4D/N65D) (SEQ ID NO: 408)
NWVDVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS Chain 2 - human_IL15Ra(Sushi)_Fc(216)_IgG1_C220S/PVA_/S267K/M428L/N434S (SEQ ID NOS 409-411)
ITCPPPMSVEHADIWVKSYSLYSRERYICNSGFKRKAGTSSLTECVLNKATNVAHWTTPSLKCIR/EPKSSDKTHTCPPCPAPPVAGPSV
FLFPPKPKDTLMISRTPEVTCVVVDVKHEDPEVKFNWYVDGVEVHNAKTKPREEQYNSTYRVVSVLTVLHQDWLNGKEYKCKVSNKALPA
PIEKTISKAKGQPREPQVYTLPPSREEMTKNQVSLTCLVKGFYPSDIAVEWESNGQPENNYKTTPPVLDSDGSFFLYSKLTVDKSRWQQG
NVFSCSVLHEALHSHYTQKSLSLSPGK

Figure 104A

>XENP20818 – human IL15-(GGGGS)₁ x human IL15Rα(Sushi)-(GGGGS)₁ Fc heterodimer

Chain 1 - human_IL15_(GGGGS)₁_Fc(216)_IgG1_pI(-
)_Isosteric_A_C220S/PVA_/S267K/L368D/K370S (15902) (SEQ ID NOS 412-414)
NWVNVISDLKKIEDLIQSMHIDATLYTESDVHPSCKVTAMKCFLLELQVISLESGDASIHDTVENLIILANNSLSSNGN
VTESGCKECEELEEKNIKEFLQSFVHIVQMFINTS/GGGGS/EPKSSDKTHTCPPCPAPPVAGPSVFLFPPKPKDTLMI
SRTPEVTCVVVDVKHEDPEVKFNWYVDGVEVHNAKTKPREEEYNSTYRVVSVLTVLHQDWLNGKEYKCKVSNKA
LPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK Chain 2 - human_IL15Rα(Sushi)_(GGGGS)₁_Fc(216)_IgG1_C220S/PVA_/S267K/S364K/E357Q
(15908) (SEQ ID NOS 415-417)
ITCPPPMSVEHADIWVKSYSLYSRERYICNSGFKRKAGTSSLTECVLNKATNVAHWTTPSLKCIR/GGGGS/EPKSSD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

>XENP20819 – human IL15-(GGGGS)₁ x human IL15Rα(Sushi)-(GGGGS)₄ Fc heterodimer

Chain 1 - human_IL15_(GGGGS)₁_Fc(216)_IgG1_pI(-
)_Isosteric_A_C220S/PVA_/S267K/L368D/K370S (15902) (SEQ ID NOS 418-420)
NWVNVISDLKKIEDLIQSMHIDATLYTESDVHPSCKVTAMKCFLLELQVISLESGDASIHDTVENLIILANNSLSSNGN
VTESGCKECEELEEKNIKEFLQSFVHIVQMFINTS/GGGGS/EPKSSDKTHTCPPCPAPPVAGPSVFLFPPKPKDTLMI
SRTPEVTCVVVDVKHEDPEVKFNWYVDGVEVHNAKTKPREEEYNSTYRVVSVLTVLHQDWLNGKEYKCKVSNKA
LPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK Chain 2 - human_IL15Rα(Sushi)_(GGGGS)₄_Fc(216)_IgG1_C220S/PVA_/S267K/S364K/E357Q
(15909) (SEQ ID NOS 421-423)
ITCPPPMSVEHADIWVKSYSLYSRERYICNSGFKRKAGTSSLTECVLNKATNVAHWTTPSLKCIR/GGGGSGGGGSG
GGGSGGGGS/EPKSSDKTHTCPPCPAPPVAGPSVFLFPPKPKDTLMISRTPEVTCVVVDVKHEDPEVKFNWYVDG
VEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEA
LHNHYTQKSLSLSPGK

Figure 104B

>XENP21471 – human IL15 x human IL15Rα(Sushi)-(GGGGS)₁ Fc heterodimer

Chain 1 - human_IL15-Fc(216)_IgG1_pI(-)_Isosteric_A_C220S/PVA_/S267K/L368D/K370S (16479) (SEQ ID NOS 424-426)
NWVNVISDLKKIEDLIQSMHIDATLYTESDVHPSCKVTAMKCFLLELQVISLESGDASIHDTVENLIILANNSLSSNGNVTES
GCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREP
QVYTLPPSREEMTKNQVSLTCDVSGFYPSDIAVEWESDGQPENNYKTTPPVLDSDGSFFLYSKLTVDKSRWEQGDVFSC
SVMHEALHNHYTQKSLSLSPGK

Chain 2 - human_IL15Rα(Sushi)_(GGGGS)₁_Fc(216)_IgG1_C220S/PVA_/S267K/S364K/E357Q (15908) (SEQ ID NOS 427-429)
ITCPPPMSVEHADIWVKSYSLYSRERYICNSGFKRKAGTSSLTECVLNKATNVAHWTTPSLKCIR/GGGGS/EPKSSDKTHT
CPPCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK >XENP21472 – human IL15-(GGGGS)₁ x human IL15Rα(Sushi) Fc heterodimer

Chain 1 - human_IL15_(GGGGS)₁_Fc(216)_IgG1_pI(-)_Isosteric_A_C220S/PVA_/S267K/L368D/K370S (15902) (SEQ ID NOS 430-432)
NWVNVISDLKKIEDLIQSMHIDATLYTESDVHPSCKVTAMKCFLLELQVISLESGDASIHDTVENLIILANNSLSSNGNVTES
GCKECEELEEKNIKEFLQSFVHIVQMFINTS/GGGGS/EPKSSDKTHTCPPCPAPPVAGPSVFLFPPKPKDTLMISRTPEVTC
VVVDVKHEDPEVKFNWYVDGVEVHNAKTKPREEEYNSTYRVVSVLTVLHQDWLNGKEYKCKVSNKALPAPIEKTISKAK
GQPREPQVYTLPPSREEMTKNQVSLTCDVSGFYPSDIAVEWESDGQPENNYKTTPPVLDSDGSFFLYSKLTVDKSRWEQ
GDVFSCSVMHEALHNHYTQKSLSLSPGK

Chain 2 - human_IL15Rα(Sushi)-Fc(216)_IgG1_C220S/PVA_/S267K/S364K/E357Q (16481) (SEQ ID NOS 433-435)
ITCPPPMSVEHADIWVKSYSLYSRERYICNSGFKRKAGTSSLTECVLNKATNVAHWTTPSLKCIR/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLTVLHQ
DWLNGKEYKCKVSNKALPAPIEKTISKAKGQPREPQVYTLPPSREQMTKNQVKLTCLVKGFYPSDIAVEWESNGQPENN
YKTTPPVLDSDGSFFLYSKLTVDKSRWQQGNVFSCSVMHEALHNHYTQKSLSLSPGK >XENP21473 – human IL15-(GGGGS)₁ x human IL15Rα(Sushi)-(GGGGS)₃ Fc heterodimer

Chain 1 - human_IL15_(GGGGS)₁_Fc(216)_IgG1_pI(-)_Isosteric_A_C220S/PVA_/S267K/L368D/K370S (15902) (SEQ ID NOS 436-438)
NWVNVISDLKKIEDLIQSMHIDATLYTESDVHPSCKVTAMKCFLLELQVISLESGDASIHDTVENLIILANNSLSSNGNVTES
GCKECEELEEKNIKEFLQSFVHIVQMFINTS/GGGGS/EPKSSDKTHTCPPCPAPPVAGPSVFLFPPKPKDTLMISRTPEVTC
VVVDVKHEDPEVKFNWYVDGVEVHNAKTKPREEEYNSTYRVVSVLTVLHQDWLNGKEYKCKVSNKALPAPIEKTISKAK
GQPREPQVYTLPPSREEMTKNQVSLTCDVSGFYPSDIAVEWESDGQPENNYKTTPPVLDSDGSFFLYSKLTVDKSRWEQ
GDVFSCSVMHEALHNHYTQKSLSLSPGK

Chain 2 - human_IL15Rα(Sushi)_(GGGGS)₃_Fc(216)_IgG1_C220S/PVA_/S267K/S364K/E357Q (16483) (SEQ ID NOS 439-441)
ITCPPPMSVEHADIWVKSYSLYSRERYICNSGFKRKAGTSSLTECVLNKATNVAHWTTPSLKCIR/GGGGSGGGGSGGGG
S/EPKSSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Figure 104C

>XENP21474 – human IL15 x human IL15Rα(Sushi)-(GGGGS)₄ Fc heterodimer

Chain 1 - human_IL15-Fc(216)_IgG1_pI(-)_Isosteric_A_C220S/PVA_/S267K/L368D/K370S (16479) (SEQ ID NOS 442-444)
NWVNVISDLKKIEDLIQSMHIDATLYTESDVHPSCKVTAMKCFLLELQVISLESGDASIHDTVENLIILANNSLSSNGNVTES
GCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREP
QVYTLPPSREEMTKNQVSLTCDVSGFYPSDIAVEWESDGQPENNYKTTPPVLDSDGSFFLYSKLTVDKSRWEQGDVFSC
SVMHEALHNHYTQKSLSLSPGK Chain 2 - human_IL15Rα(Sushi)_(GGGGS)₄_Fc(216)_IgG1_C220S/PVA_/S267K/S364K/E357Q (15909) (SEQ ID NOS 445-447)
ITCPPPMSVEHADIWVKSYSLYSRERYICNSGFKRKAGTSSLTECVLNKATNVAHWTTPSLKCIR/GGGGSGGGGSGGGG
SGGGGS/EPKSSDKTHTCPPCPAPPVAGPSVFLFPPKPKDTLMISRTPEVTCVVVDVKHEDPEVKFNWYVDGVEVHNAK
TKPREEQYNSTYRVVSVLTVLHQDWLNGKEYKCKVSNKALPAPIEKTISKAKGQPREPQVYTLPPSREQMTKNQVKLTCL
VKGFYPSDIAVEWESNGQPENNYKTTPPVLDSDGSFFLYSKLTVDKSRWQQGNVFSCSVMHEALHNHYTQKSLSLSPGK >XENP21475 – human IL15 x human IL15Rα(Sushi) Fc heterodimer Chain 1 - human_IL15-Fc(216)_IgG1_pI(-)_Isosteric_A_C220S/PVA_/S267K/L368D/K370S (16479) (SEQ ID NOS 448-450)
NWVNVISDLKKIEDLIQSMHIDATLYTESDVHPSCKVTAMKCFLLELQVISLESGDASIHDTVENLIILANNSLSSNGNVTES
GCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREP
QVYTLPPSREEMTKNQVSLTCDVSGFYPSDIAVEWESDGQPENNYKTTPPVLDSDGSFFLYSKLTVDKSRWEQGDVFSC
SVMHEALHNHYTQKSLSLSPGK Chain 2 - human_IL15Rα(Sushi)-Fc(216)_IgG1_C220S/PVA_/S267K/S364K/E357Q (16481) (SEQ ID NOS 451-453)
ITCPPPMSVEHADIWVKSYSLYSRERYICNSGFKRKAGTSSLTECVLNKATNVAHWTTPSLKCIR/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLTVLHQ
DWLNGKEYKCKVSNKALPAPIEKTISKAKGQPREPQVYTLPPSREQMTKNQVKLTCLVKGFYPSDIAVEWESNGQPENN
YKTTPPVLDSDGSFFLYSKLTVDKSRWQQGNVFSCSVMHEALHNHYTQKSLSLSPGK >XENP21476 – human IL15-(GGGGS)₂ x human IL15Rα(Sushi)-(GGGGS)₂ Fc heterodimer Chain 1 - human_IL15_(GGGGS)₂_Fc(216)_IgG1_pI(-)_Isosteric_A_C220S/PVA_/S267K/L368D/K370S (16480) (SEQ ID NOS 454-456)
NWVNVISDLKKIEDLIQSMHIDATLYTESDVHPSCKVTAMKCFLLELQVISLESGDASIHDTVENLIILANNSLSSNGNVTES
GCKECEELEEKNIKEFLQSFVHIVQMFINTS/GGGGSGGGGS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPIEK
TISKAKGQPREPQVYTLPPSREEMTKNQVSLTCDVSGFYPSDIAVEWESDGQPENNYKTTPPVLDSDGSFFLYSKLTVDKS
RWEQGDVFSCSVMHEALHNHYTQKSLSLSPGK Chain 2 - human_IL15Ra(Sushi)_(GGGGS)₂_Fc(216)_IgG1_C220S/PVA_/S267K/S364K/E357Q (16482) (SEQ ID NOS 457-459)
ITCPPPMSVEHADIWVKSYSLYSRERYICNSGFKRKAGTSSLTECVLNKATNVAHWTTPSLKCIR/GGGGSGGGGS/EPKS
SDKTHTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYPSDIAV
EWESNGQPENNYKTTPPVLDSDGSFFLYSKLTVDKSRWQQGNVFSCSVMHEALHNHYTQKSLSLSPGK

Figure 104D

>XENP21477 – human IL15-(GGGGS)₂ x human IL15Rα(Sushi)-(GGGGS)₄ Fc heterodimer

Chain 1 - human_IL15_(GGGGS)₂_Fc(216)_IgG1_pI(-)_Isosteric_A_C220S/PVA_/S267K/L368D/K370S (16480) (SEQ ID NOS 460-462)
NWVNVISDLKKIEDLIQSMHIDATLYTESDVHPSCKVTAMKCFLLELQVISLESGDASIHDTVENLIILANNSLSSNGN
VTESGCKECEELEEKNIKEFLQSFVHIVQMFINTS/GGGGSGGGGS/EPKSSDKTHTCPPCPAPPVAGPSVFLFPPKP
KDTLMISRTPEVTCVVVDVKHEDPEVKFNWYVDGVEVHNAKTKPREEEYNSTYRVVSVLTVLHQDWLNGKEYKCK
VSNKALPAPIEKTISKAKGQPREPQVYTLPPSREEMTKNQVSLTCDVSGFYPSDIAVEWESDGQPENNYKTTPPVLD
SDGSFFLYSKLTVDKSRWEQGDVFSCSVMHEALHNHYTQKSLSLSPGK

Chain 2 - human_IL15Rα(Sushi)_(GGGGS)4_Fc(216)_IgG1_C220S/PVA_/S267K/S364K/E357Q (15909) (SEQ ID NOS 463-465)
ITCPPPMSVEHADIWVKSYSLYSRERYICNSGFKRKAGTSSLTECVLNKATNVAHWTTPSLKCIR/GGGGSGGGGSG
GGGSGGGGS/EPKSSDKTHTCPPCPAPPVAGPSVFLFPPKPDTLMISRTPEVTCVVVDVKHEDPEVKFNWYVDG
VEVHNAKTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSVMHEA
LHNHYTQKSLSLSPGK >XENP21478 – human IL15Rα(Sushi)-(GGGGS)₆-human IL15(single-chain) Fc heterodimer

Chain 1 - human_IL15Rα(sushi)_(GGGGS)₆-human_IL15-Fc(216)_IgG1_pI(-)_Isosteric_A_C220S/PVA_/S267K/L368D/K370S (16478) (SEQ ID NOS 466-469)
ITCPPPMSVEHADIWVKSYSLYSRERYICNSGFKRKAGTSSLTECVLNKATNVAHWTTPSLKCIR/GGGGSGGGGSG
GGGSGGGGSGGGGSGGGGS/NWVNVISDLKKIEDLIQSMHIDATLYTESDVHPSCKVTAMKCFLLELQVISLESGD
ASIHDTVENLIILANNSLSSNGNVTESGCKECEELEEKNIKEFLQSFVHIVQMFINTS/EPKSSDKTHTCPPCPAPPVA
GPSVFLFPPKPDTLMISRTPEVTCVVVDVKHEDPEVKFNWYVDGVEVHNAKTKPREEEYNSTYRVVSVLTVLHQD
WLNGKEYKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK

Chain 2 - empty-Fc(216)_IgG1_C220S/PVA_/S267K/S364K/E357Q (8924) (SEQ ID NO: 470)
EPKSSDKTHTCPPCPAPPVAGPSVFLFPPKPDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCL
VKGFYPSDIAVEWESNGQPENNYKTTPPVLDSDGSFFLYSKLTVDKSRWQQGNVFSCSVMHEALHNHYTQKSLSL
SPGK

Figure 104E

>XENP21479 – empty-Fc-IL15(non-covalent)-human_IL15Rα(Sushi) Fc heterodimer

Chain 1 - human_IL15_no_tag (16484) (SEQ ID NO: 471)
NWVNVISDLKKIEDLIQSMHIDATLYTESDVHPSCKVTAMKCFLLELQVISLESGDASIHDTVENLIILANNSLSSNGN
VTESGCKECEELEEKNIKEFLQSFVHIVQMFINTS

Chain 2 - empty-Fc(216)_IgG1_pI(-)_Isosteric_A_C220S/PVA_/S267K/L368D/K370S (8793) (SEQ ID NO: 472)
EPKSSDKTHTCPPCPAPPVAGPSVFLFPPKPKDTLMISRTPEVTCVVVDVKHEDPEVKFNWYVDGVEVHNAKTKPR
EEEYNSTYRVVSVLTVLHQDWLNGKEYKCKVSNKALPAPIEKTISKAKGQPREPQVYTLPPSREEMTKNQVSLTCDV
SGFYPSDIAVEWESDGQPENNYKTTPPVLDSDGSFFLYSKLTVDKSRWEQGDVFSCSVMHEALHNHYTQKSLSLSP
GK

Chain 3 - human_IL15Rα(Sushi)-Fc(216)_IgG1_C220S/PVA_/S267K/S364K/E357Q (16481) (SEQ ID NOS 473-475)
ITCPPPMSVEHADIWVKSYSLYSRERYICNSGFKRKAGTSSLTECVLNKATNVAHWTTPSLKCIR/EPKSSDKTHTCP
PCPAPPVAGPSVFLFPPKPKDTLMISRTPEVTCVVVDVKHEDPEVKFNWYVDGVEVHNAKTKPREEQYNSTYRVV
SVLTVLHQDWLNGKEYKCKVSNKALPAPIEKTISKAKGQPREPQVYTLPPSREQMTKNQVKLTCLVKGFYPSDIAVE
WESNGQPENNYKTTPPVLDSDGSFFLYSKLTVDKSRWQQGNVFSCSVMHEALHNHYTQKSLSLSPGK

>XENP021978 – human_IL15(non-covalent)-human_IL15Ra(Sushi)_Fc(216)_IgG1_C220S/PVA_/S267K

Chain 1 - human_IL15Rα(Sushi)-Fc(216)_IgG1_C220S/PVA_/S267K (17023) (SEQ ID NOS 476-478)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Chain 2 - human_IL15_no_tag (16484) (SEQ ID NO: 479)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

>XENP021979 – human_IL15_N72D_(non-covalent)-human_IL15Ra(Sushi)_Fc(216)_IgG1_C220S/PVA_/S267K

Chain 1 - human_IL15Rα(Sushi)-Fc(216)_IgG1_C220S/PVA_/S267K (17023) (SEQ ID NOS 480-482)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Chain 2 - human_IL15_N72D_no_tag (17076) (SEQ ID NO: 483)
NWVNVISDLKKIEDLIQSMHIDATLYTESDVHPSCKVTAMKCFLLELQVISLESGDASIHDTVENLIILANDSLS
SNGNVTESGCKECEELEEKNIKEFLQSFVHIVQMFINTS

Figure 104F

>XENP021988 human_IL15_(GGGGS)1-human_IL15Ra(Sushi-D96)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 – human_IL15_(GGGGS)1_Fc(216)_IgG1_pI(-)_Isosteric_A_C220S/PVA_/S267K/L368D/K370S (SEQ ID NOS 484-486)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 – human_IL15Ra(Sushi-D96)_(GGGGS)1_c(216)_IgG1_C220S/PVA_/S267K/S364K/E357Q (SEQ ID NOS 487-489)
ITCPPPMSVEHADIWVKSYSLYSRERYICNSGFKRKAGTSSLTECVLNKATNVAHWTTPSLKCIRD/GGGGS/EP
KSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCL
VKGFYPSDIAVEWESNGQPENNYKTTPPVLDSDGSFFLYSKLTVDKSRWQQGNVFSCSVMHEALHNHYTQKSLSL
SPGK >XENP021989 human_IL15_(GGGGS)1-human_IL15Ra(Sushi-D96/P97)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_(GGGGS)1_(GGGGS)1_Fc(216)_IgG1_pI(-)_Isosteric_A_C220S/PVA_/S267K/L368D/K370S (SEQ ID NOS 490-492)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi-D96/P97)_(GGGGS)1_Fc(216)_IgG1_C220S/PVA_/S267K/S364K/E357Q (SEQ ID NOS 493-495)
ITCPPPMSVEHADIWVKSYSLYSRERYICNSGFKRKAGTSSLTECVLNKATNVAHWTTPSLKCIRDP/GGGGS/E
PKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTC
LVKGFYPSDIAVEWESNGQPENNYKTTPPVLDSDGSFFLYSKLTVDKSRWQQGNVFSCSVMHEALHNHYTQKSLS
LSPGK >XENP021990 human_IL15_(GGGGS)1-human_IL15Ra(Sushi-D96/P97/A98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_(GGGGS)1_Fc(216)_IgG1_pI(-)_Isosteric_A_C220S/PVA_/S267K/L368D/K370S (SEQ ID NOS 496-498)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi-D96/P97/A98)_(GGGGS)1_Fc(216)_IgG1_C220S/PVA_/S267K/S364K/E357Q (SEQ ID NOS 499-501)
ITCPPPMSVEHADIWVKSYSLYSRERYICNSGFKRKAGTSSLTECVLNKATNVAHWTTPSLKCIRDPA/GGGGS/
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 104G

>XENP021991 human_IL15_(GGGGS)1-human_IL15Ra(Sushi-D96/P97/A98)_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_(GGGGS)1_Fc(216)_IgG1_pI(-)_Isosteric_A_C220S/PVA_/S267K/L368D/K370S (SEQ ID NOS 502-504)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi-D96/P97/A98)_Fc(216)_IgG1_C220S/PVA_/S267K/S364K/E357Q (SEQ ID NOS 505-507)
ITCPPPMSVEHADIWVKSYSLYSRERYICNSGFKRKAGTSSLTECVLNKATNVAHWTTPSLKCIRDPA/EPKSSD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK >XENP021992 human_IL15-human_IL15Ra(Sushi-D96/P97/A98)_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_Fc(216)_IgG1_pI(-)_Isosteric_A_C220S/PVA_/S267K/L368D/K370S (SEQ ID NOS 508-510)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 - human_IL15Ra(Sushi-D96/P97/A98)_Fc(216)_IgG1_C220S/PVA_/S267K/S364K/E357Q (SEQ ID NOS 511-513)
ITCPPPMSVEHADIWVKSYSLYSRERYICNSGFKRKAGTSSLTECVLNKATNVAHWTTPSLKCIRDPA/EPKSSD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK >XENP021993 human_IL15Ra(sushi)_(GGGGS)5-human_IL15(single-chain)-empty-Fc_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15Ra(sushi)_(GGGGS)5-human_IL15(single-chain)_Fc(216)_IgG1_pI(-
)_Isosteric_A_C220S/PVA_/S267K/L368D/K370S (SEQ ID NOS 514-517)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK
Chain 2 – empty_Fc(216)_IgG1_C220S/PVA_/S267K/S364K/E357Q (SEQ ID NO: 518)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 104H

>XENP021994 human_IL15Ra(sushi)_(GGGGS)4-human_IL15(single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15Ra(sushi)_(GGGGS)4-human_IL15(single-chain)_Fc(216)_IgG1_pI(-)_Isosteric_A_C220S/PVA_/S267K/L368D/K370S (SEQ ID NOS 519-522)
ITCPPPMSVEHADIWVKSYSLYSRERYICNSGFKRKAGTSSLTECVLNKATNVAHWTTPSLKCIR/GGGGSGGGGSGGGGSGGGG
S/NWVNVISDLKKIEDLIQSMHIDATLYTESDVHPSCKVTAMKCFLLELQVISLESGDASIHDTVENLIILANNSLSSNGNVTES
GCKECEELEEKNIKEFLQSFVHIVQMFINTS/EPKSSDKTHTCPPCPAPPVAGPSVFLFPPKPKDTLMISRTPEVTCVVVDVKHE
DPEVKFNWYVDGVEVHNAKTKPREEEYNSTYRVVSVLTVLHQDWLNGKEYKCKVSNKALPAPIEKTISKAKGQPREPQVYTLPPS
REEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 – empty_Fc(216)_IgG1_C220S/PVA_/S267K/S364K/E357Q (SEQ ID NO: 523)
EPKSSDKTHTCPPCPAPPVAGPSVFLFPPKPKDTLMISRTPEVTCVVVDVKHEDPEVKFNWYVDGVEVHNAKTKPREEQYNSTYR
VVSVLTVLHQDWLNGKEYKCKVSNKALPAPIEKTISKAKGQPREPQVYTLPPSREQMTKNQVKLTCLVKGFYPSDIAVEWESNGQ
PENNYKTTPPVLDSDGSFFLYSKLTVDKSRWQQGNVFSCSVMHEALHNHYTQKSLSLSPGK >XENP021995 human_IL15Ra(sushi)_(GGGGS)3-human_IL15(single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15Ra(sushi)_(GGGGS)3-human_IL15(single-chain)_Fc(216)_IgG1_pI(-)_Isosteric_A_C220S/PVA_/S267K/L368D/K370S (SEQ ID NOS 524-527)
ITCPPPMSVEHADIWVKSYSLYSRERYICNSGFKRKAGTSSLTECVLNKATNVAHWTTPSLKCIR/GGGGSGGGGSGGGGS/NWV
NVISDLKKIEDLIQSMHIDATLYTESDVHPSCKVTAMKCFLLELQVISLESGDASIHDTVENLIILANNSLSSNGNVTESGCKEC
EELEEKNIKEFLQSFVHIVQMFINTS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVYTLPPSREEMT
KNQVSLTCDVSGFYPSDIAVEWESDGQPENNYKTTPPVLDSDGSFFLYSKLTVDKSRWEQGDVFSCSVMHEALHNHYTQKSLSLS
PGK Chain 2 – empty_Fc(216)_IgG1_C220S/PVA_/S267K/S364K/E357Q (SEQ ID NO: 528)
EPKSSDKTHTCPPCPAPPVAGPSVFLFPPKPKDTLMISRTPEVTCVVVDVKHEDPEVKFNWYVDGVEVHNAKTKPREEQYNSTYR
VVSVLTVLHQDWLNGKEYKCKVSNKALPAPIEKTISKAKGQPREPQVYTLPPSREQMTKNQVKLTCLVKGFYPSDIAVEWESNGQ
PENNYKTTPPVLDSDGSFFLYSKLTVDKSRWQQGNVFSCSVMHEALHNHYTQKSLSLSPGK >XENP021996 - human_IL15(non-covalent)-human_IL15Ra(Sushi)-6x-His Chain 1 - human_IL15_no_tag (16484) (SEQ ID NO: 529)
NWVNVISDLKKIEDLIQSMHIDATLYTESDVHPSCKVTAMKCFLLELQVISLESGDASIHDTVENLIILAN
NSLSSNGNVTESGCKECEELEEKNIKEFLQSFVHIVQMFINTS Chain 2 - human_IL15Ra(Sushi)-6x-His (17033) (SEQ ID NO: 530)
ITCPPPMSVEHADIWVKSYSLYSRERYICNSGFKRKAGTSSLTECVLNKATNVAHWTTPSLKCIR >XENP022001 - human_IL15(non-covalent)-human_IL15Ra(Sushi-D96)-6x-His Chain 1 - human_IL15_no_tag (16484) (SEQ ID NO: 531)
NWVNVISDLKKIEDLIQSMHIDATLYTESDVHPSCKVTAMKCFLLELQVISLESGDASIHDTVENLIILAN
NSLSSNGNVTESGCKECEELEEKNIKEFLQSFVHIVQMFINTS Chain 2 - human_IL15Ra(Sushi-D96)-6x-His (17048) (SEQ ID NO: 532)
ITCPPPMSVEHADIWVKSYSLYSRERYICNSGFKRKAGTSSLTECVLNKATNVAHWTTPSLKCIRD

Figure 104I

>XENP022002 - human_IL15(non-covalent)-human_IL15Ra(Sushi-D96/P97)-6x-His

Chain 1 - human_IL15_no_tag (16484) (SEQ ID NO: 533)
NWVNVISDLKKIEDLIQSMHIDATLYTESDVHPSCKVTAMKCFLLELQVISLESGDASIHDTVENLII
LANNSLSSNGNVTESGCKECEELEEKNIKEFLQSFVHIVQMFINTS Chain 2 - human_IL15Ra(Sushi-D96/P97)-6x-His (17049) (SEQ ID NO: 534)
ITCPPPMSVEHADIWVKSYSLYSRERYICNSGFKRKAGTSSLTECVLNKATNVAHWTTPSLKCIRDP >XENP022003 - human_IL15(non-covalent)-human_IL15Ra(Sushi-D96/P97/A98)-6x-His Chain 1 - human_IL15_no_tag (16484) (SEQ ID NO: 535)
NWVNVISDLKKIEDLIQSMHIDATLYTESDVHPSCKVTAMKCFLLELQVISLESGDASIHDTVENLII
LANNSLSSNGNVTESGCKECEELEEKNIKEFLQSFVHIVQMFINTS Chain 2 - human_IL15Ra(Sushi-D96/P97/A98)-6x-His (17050) (SEQ ID NO: 536)
ITCPPPMSVEHADIWVKSYSLYSRERYICNSGFKRKAGTSSLTECVLNKATNVAHWTTPSLKCIRDPA >XENP022004 - human_IL15_E87C-human_IL15Ra(Sushi-D96/C97)-6x-His Chain 1 - human_IL15_E87C_no_tag (17074) (SEQ ID NO: 537)
NWVNVISDLKKIEDLIQSMHIDATLYTESDVHPSCKVTAMKCFLLELQVISLESGDASIHDTVENLII
LANNSLSSNGNVTESGCKECEELEEKNIKEFLQSFVHIVQMFINTS Chain 2 - human_IL15Ra(Sushi-D96/C97)-6x-His (17051) (SEQ ID NO: 538)
ITCPPPMSVEHADIWVKSYSLYSRERYICNSGFKRKAGTSSLTECVLNKATNVAHWTTPSLKCIRDC >XENP022005 - human_IL15_E87C-human_IL15Ra(Sushi-D96/P97/C98)-6x-His Chain 1 - human_IL15_E87C_no_tag (17074) (SEQ ID NO: 539)
NWVNVISDLKKIEDLIQSMHIDATLYTESDVHPSCKVTAMKCFLLELQVISLESGDASIHDTVENLII
LANNSLSSNGNVTESGCKECEELEEKNIKEFLQSFVHIVQMFINTS Chain 2 - human_IL15Ra(Sushi-D96/P97/C98)-6x-His (17052) (SEQ ID NO: 540)
ITCPPPMSVEHADIWVKSYSLYSRERYICNSGFKRKAGTSSLTECVLNKATNVAHWTTPSLKCIRDPC >XENP022006 - human_IL15_E87C-human_IL15Ra(Sushi-D96/C97/A98)-6x-His Chain 1 - human_IL15_E87C_no_tag (17074) (SEQ ID NO: 541)
NWVNVISDLKKIEDLIQSMHIDATLYTESDVHPSCKVTAMKCFLLELQVISLESGDASIHDTVENLII
LANNSLSSNGNVTESGCKECEELEEKNIKEFLQSFVHIVQMFINTS Chain 2 - human_IL15Ra(Sushi-D96/C97/A98)-6x-His (17053) (SEQ ID NO: 542)
ITCPPPMSVEHADIWVKSYSLYSRERYICNSGFKRKAGTSSLTECVLNKATNVAHWTTPSLKCIRDCA

Figure 104J

>XENP022007 - human_IL15_V49C-human_IL15Ra(Sushi-S40C)-6x-His

Chain 1 - human_IL15_V49C_no_tag (17071) (SEQ ID NO: 543)
NWVNVISDLKKIEDLIQSMHIDATLYTESDVHPSCKVTAMKCFLLELQCISLESGDASIHDTVENLII
LANNSLSSNGNVTESGCKECEELEEKNIKEFLQSFVHIVQMFINTS Chain 2 - human_IL15Ra(Sushi-S40C)-6x-His (17057) (SEQ ID NO: 544)
ITCPPPMSVEHADIWVKSYSLYSRERYICNSGFKRKAGTCSLTECVLNKATNVAHWTTPSLKCIR >XENP022008 - human_IL15_L52C-human_IL15Ra(Sushi-S40C)-6x-His Chain 1 - human_IL15_L52C_no_tag (17072) (SEQ ID NO: 545)
NWVNVISDLKKIEDLIQSMHIDATLYTESDVHPSCKVTAMKCFLLELQVISCESGDASIHDTVENLII
LANNSLSSNGNVTESGCKECEELEEKNIKEFLQSFVHIVQMFINTS Chain 2 - human_IL15Ra(Sushi-S40C)-6x-His (17057) (SEQ ID NO: 546)
ITCPPPMSVEHADIWVKSYSLYSRERYICNSGFKRKAGTCSLTECVLNKATNVAHWTTPSLKCIR >XENP022009 - human_IL15_E89C-human_IL15Ra(Sushi-K34C)-6x-His Chain 1 - human_IL15_E89C_no_tag (17075) (SEQ ID NO: 547)
NWVNVISDLKKIEDLIQSMHIDATLYTESDVHPSCKVTAMKCFLLELQVISLESGDASIHDTVENLII
LANNSLSSNGNVTESGCKECCELEEKNIKEFLQSFVHIVQMFINTS Chain 2 - human_IL15Ra(Sushi-K34C)-6x-His (17054) (SEQ ID NO: 548)
ITCPPPMSVEHADIWVKSYSLYSRERYICNSGFCRKAGTSSLTECVLNKATNVAHWTTPSLKCIR >XENP022010 - human_IL15_Q48C-human_IL15Ra(Sushi-G38C)-6x-His Chain 1 - human_IL15_Q48C_no_tag (17070) (SEQ ID NO: 549)
NWVNVISDLKKIEDLIQSMHIDATLYTESDVHPSCKVTAMKCFLLELCVISLESGDASIHDTVENLII
LANNSLSSNGNVTESGCKECEELEEKNIKEFLQSFVHIVQMFINTS Chain 2 - human_IL15Ra(Sushi-G38C)-6x-His (17056) (SEQ ID NO: 550)
ITCPPPMSVEHADIWVKSYSLYSRERYICNSGFKRKACTSSLTECVLNKATNVAHWTTPSLKCIR >XENP022011 - human_IL15_E53C-human_IL15Ra(Sushi-L42C)-6x-His Chain 1 - human_IL15_E53C_no_tag (17073) (SEQ ID NO: 551)
NWVNVISDLKKIEDLIQSMHIDATLYTESDVHPSCKVTAMKCFLLELQVISLCSGDASIHDTVENLII
LANNSLSSNGNVTESGCKECEELEEKNIKEFLQSFVHIVQMFINTS Chain 2 - human_IL15Ra(Sushi-L42C)-6x-His (17058) (SEQ ID NO: 552)
ITCPPPMSVEHADIWVKSYSLYSRERYICNSGFKRKAGTSSCTECVLNKATNVAHWTTPSLKCIR

Figure 104K

>XENP022012 - human_IL15_C42S-human_IL15Ra(Sushi-A37C)-6x-His

Chain 1 - human_IL15_C42S_no_tag (17083) (SEQ ID NO: 553)
NWVNVISDLKKIEDLIQSMHIDATLYTESDVHPSCKVTAMKSFLLELQVISLESGDASIHDTVENLII
LANNSLSSNGNVTESGCKECEELEEKNIKEFLQSFVHIVQMFINTS Chain 2 - human_IL15Ra(Sushi-L42C)-6x-His (17055) (SEQ ID NO: 554)
ITCPPPMSVEHADIWVKSYSLYSRERYICNSGFKRKCGTSSLTECVLNKATNVAHWTTPSLKCIR >XENP022013 human_IL15_E87C_(GGGGS)1-human_IL15Ra(Sushi-
D96/C97)_(GGGGS)1_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15_E87C_(GGGGS)1_Fc(216)_IgG1_pI(-
)_Isosteric_A_C220S/PVA_/S267K/L368D/K370S (SEQ ID NOS 555-557)
NWVNVISDLKKIEDLIQSMHIDATLYTESDVHPSCKVTAMKCFLLELQVISLESGDASIHDTVENLIILANNSLSSNGNV
TESGCKCCEELEEKNIKEFLQSFVHIVQMFINTS/GGGGS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPIEKT
ISKAKGQPREPQVYTLPPSREEMTKNQVSLTCDVSGFYPSDIAVEWESDGQPENNYKTTPPVLDSDGSFFLYSKLTVDKS
RWEQGDVFSCSVMHEALHNHYTQKSLSLSPGK Chain 2 - human_IL15Ra(Sushi-
D96/C97)_(GGGGS)1_Fc(216)_IgG1_C220S/PVA_/S267K/S364K/E357Q (SEQ ID NOS 558-560)
ITCPPPMSVEHADIWVKSYSLYSRERYICNSGFKRKAGTSSLTECVLNKATNVAHWTTPSLKCIRDC/GGGGS/EPKSSD
KTHTCPPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK >XENP022014 human_IL15_E87C_(GGGGS)1-human_IL15Ra(Sushi-
D96/P97/C98)_(GGGGS)1_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15_E87C_(GGGGS)1_Fc(216)_IgG1_pI(-
)_Isosteric_A_C220S/PVA_/S267K/L368D/K370S (SEQ ID NOS 561-563)
NWVNVISDLKKIEDLIQSMHIDATLYTESDVHPSCKVTAMKCFLLELQVISLESGDASIHDTVENLIILANNSLSSNGNV
TESGCKCCEELEEKNIKEFLQSFVHIVQMFINTS/GGGGS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPIEKT
ISKAKGQPREPQVYTLPPSREEMTKNQVSLTCDVSGFYPSDIAVEWESDGQPENNYKTTPPVLDSDGSFFLYSKLTVDKS
RWEQGDVFSCSVMHEALHNHYTQKSLSLSPGK Chain 2 - human_IL15Ra(Sushi-
D96/P97/C98)_(GGGGS)1_Fc(216)_IgG1_C220S/PVA_/S267K/S364K/E357Q (SEQ ID NOS 564-566)
ITCPPPMSVEHADIWVKSYSLYSRERYICNSGFKRKAGTSSLTECVLNKATNVAHWTTPSLKCIRDPC/GGGGS/EPKSS
DKTHTCPPCPAPPVAGPSVFLFPPKPKDTLMISRTPEVTCVVVDVKHEDPEVKFNWYVDGVEVHNAKTKPREEQYNSTYR
VVSVLTVLHQDWLNGKEYKCKVSNKALPAPIEKTISKAKGQPREPQVYTLPPSREQMTKNQVKLTCLVKGFYPSDIAVEW
ESNGQPENNYKTTPPVLDSDGSFFLYSKLTVDKSRWQQGNVFSCSVMHEALHNHYTQKSLSLSPGK

Figure 104K (continued)

>XENP022015 human_IL15_E87C_(GGGGS)1-human_IL15Ra(Sushi-D96/C97/A98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_E87C_(GGGGS)1_Fc(216)_IgG1_pI(-)_Isosteric_A_C220S/PVA_/S267K/L368D/K370S (SEQ ID NOS 567-569)

NWVNVISDLKKIEDLIQSMHIDATLYTESDVHPSCKVTAMKCFLLELQVISLESGDASIHDTVENLIILANNSLSSNGNV
TESGCKCCEELEEKNIKEFLQSFVHIVQMFINTS/GGGGS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPIEKT
ISKAKGQPREPQVYTLPPSREEMTKNQVSLTCDVSGFYPSDIAVEWESDGQPENNYKTTPPVLDSDGSFFLYSKLTVDKS
RWEQGDVFSCSVMHEALHNHYTQKSLSLSPGK

Chain 2 - human_IL15Ra(Sushi-D96/C97/A98)_(GGGGS)1_Fc(216)_IgG1_C220S/PVA_/S267K/S364K/E357Q (SEQ ID NOS 570-572)

ITCPPPMSVEHADIWVKSYSLYSRERYICNSGFKRKAGTSSLTECVLNKATNVAHWTTPSLKCIRDCA/GGGGS/EPKSS
DKTHTCPPCPAPPVAGPSVFLFPPKPKDTLMISRTPEVTCVVVDVKHEDPEVKFNWYVDGVEVHNAKTKPREEQYNSTYR
VVSVLTVLHQDWLNGKEYKCKVSNKALPAPIEKTISKAKGQPREPQVYTLPPSREQMTKNQVKLTCLVKGFYPSDIAVEW
ESNGQPENNYKTTPPVLDSDGSFFLYSKLTVDKSRWQQGNVFSCSVMHEALHNHYTQKSLSLSPGK

Figure 104L

>XENP022017 human_IL15_L52C_(GGGGS)1-human_IL15Ra(Sushi-S40C)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 – human_IL15_L52C_(GGGGS)1-_Fc(216)_IgG1_pI(-)_Isosteric_A_C220S/PVA_/S267K/L368D/K370S (SEQ ID NOS 573-575)
NWVNVISDLKKIEDLIQSMHIDATLYTESDVHPSCKVTAMKCFLLELQVISCESGDASIHDTVENLIILANNSLSSNGNVTESGCKECEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK Chain 2 – human_IL15Ra(Sushi-S40C)_(GGGGS)1_Fc(216)_IgG1_C220S/PVA_/S267K/S364K/E357Q (SEQ ID NOS 576-578)
ITCPPPMSVEHADIWVKSYSLYSRERYICNSGFKRKAGTSCSLTECVLNKATNVAHWTTPSLKCIR/GGGGS/EPKSSDKTHTCPPCPAPP
VAGPSVFLFPPKPKDTLMISRTPEVTCVVVDVKHEDPEVKFNWYVDGVEVHNAKTKPREEEQYNSTYRVVSVLTVLHQDWLNGKEYKCKVS
NKALPAPIEKTISKAKGQPREPQVYTLPPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK >XENP022049 - human_IL15Ra(sushi)_(GGGGS)6-human_IL15-sc-6x-His Chain 1 - human_IL15Ra(sushi)_(GGGGS)6-human_IL15-sc-6x-His (17032) (SEQ ID NOS 579-581)
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGS/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVQMFINTS >XENP022354 – empty-Fc-IL15(non-covalent)-human_IL15Ra(Sushi-D96)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_no_tag (16484) (SEQ ID NO: 582)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS Chain 2 - empty-Fc(216)_IgG1_pI(-)_Isosteric_A_C220S/PVA_/S267K/L368D/K370S (8793) (SEQ ID NO: 583)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 3 - human_IL15Ra(Sushi-D96)_(GGGGS)1_Fc(216)_IgG1_C220S/PVA_/S267K/S364K/E357Q (17034) (SEQ ID NOS 584-586)
ITCPPPMSVEHADIWVKSYSLYSRERYICNSGFKRKAGTSSLTECVLNKATNVAHWTTPSLKCIRD/GGGGS/EP
KSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCL
VKGFYPSDIAVEWESNGQPENNYKTTPPVLDSDGSFFLYSKLTVDKSRWQQGNVFSCSVMHEALHNHYTQKSLSL
SPGK

Figure 104M

>XENP022355 – empty-Fc-IL15(non-covalent)-human_IL15Ra(Sushi-D96/P97)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_no_tag (16484) (SEQ ID NO: 587)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS Chain 2 - empty-Fc(216)_IgG1_pI(-)_Isosteric_A_C220S/PVA_/S267K/L368D/K370S (8793) (SEQ ID NO: 588)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 3 - human_IL15Ra(Sushi-D96/P97)_(GGGGS)1_Fc(216)_IgG1_C220S/PVA_/S267K/S364K/E357Q (SEQ ID NOS 589-591)
ITCPPPMSVEHADIWVKSYSLYSRERYICNSGFKRKAGTSSLTECVLNKATNVAHWTTPSLKCIRDP/GGGGS/E
PKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTC
LVKGFYPSDIAVEWESNGQPENNYKTTPPVLDSDGSFFLYSKLTVDKSRWQQGNVFSCSVMHEALHNHYTQKSLS
LSPGK >XENP022356 – empty-Fc-IL15(non-covalent)-human_IL15Ra(Sushi-D96/P97/A98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_no_tag (16484) (SEQ ID NO: 592)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS Chain 2 - empty-Fc(216)_IgG1_pI(-)_Isosteric_A_C220S/PVA_/S267K/L368D/K370S (8793) (SEQ ID NO: 593)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 3 - human_IL15Ra(Sushi-D96/P97/A98)_(GGGGS)1_Fc(216)_IgG1_C220S/PVA_/S267K/S364K/E357Q (17036) (SEQ ID NOS 594-596)
ITCPPPMSVEHADIWVKSYSLYSRERYICNSGFKRKAGTSSLTECVLNKATNVAHWTTPSLKCIRDPA/GGGGS/
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 104N

>XENP022357 – empty-Fc-IL15_E87C-human_IL15Ra(Sushi-D96/C97)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_no_tag (17074) (SEQ ID NO: 597)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

Chain 2 - empty-Fc(216)_IgG1_pI(-)_Isosteric_A_C220S/PVA_/S267K/L368D/K370S (8793) (SEQ ID NO: 598)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi-D96/C97)_(GGGGS)1_Fc(216)_IgG1_C220S/PVA_/S267K/S364K/E357Q (17038) (SEQ ID NOS 599-601)
ITCPPPMSVEHADIWVKSYSLYSRERYICNSGFKRKAGTSSLTECVLNKATNVAHWTTPSLKCIRDC/GGGGS/E
PKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTC
LVKGFYPSDIAVEWESNGQPENNYKTTPPVLDSDGSFFLYSKLTVDKSRWQQGNVFSCSVMHEALHNHYTQKSLS
LSPGK

>XENP022358 – empty-Fc-IL15_E87C-human_IL15Ra(Sushi-D96/P97/C98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_no_tag (17074) (SEQ ID NO: 602)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

Chain 2 - empty-Fc(216)_IgG1_pI(-)_Isosteric_A_C220S/PVA_/S267K/L368D/K370S (8793) (SEQ ID NO: 603)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi-D96/P97/C98)_(GGGGS)1_Fc(216)_IgG1_C220S/PVA_/S267K/S364K/E357Q (17039) (SEQ ID NOS 604-606)
ITCPPPMSVEHADIWVKSYSLYSRERYICNSGFKRKAGTSSLTECVLNKATNVAHWTTPSLKCIRDPC/GGGGS/
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 104O

>XENP022359 – empty-Fc-IL15_E87C-human_IL15Ra(Sushi-D96/C97/A98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_E87C_no_tag (17074) (SEQ ID NO: 607)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS Chain 2 - empty-Fc(216)_IgG1_pI(-)_Isosteric_A_C220S/PVA_/S267K/L368D/K370S (8793) (SEQ ID NO: 608)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 3 - human_IL15Ra(Sushi-D96/C97/A98)_(GGGGS)1_Fc(216)_IgG1_C220S/PVA_/S267K/S364K/E357Q (17040) (SEQ ID NOS 609-611)
ITCPPPMSVEHADIWVKSYSLYSRERYICNSGFKRKAGTSSLTECVLNKATNVAHWTTPSLKCIRDCA/GGGGS/
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP022360 – empty-Fc-IL15_V49C-human_IL15Ra(Sushi-S40C)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_V49C_no_tag (17071) (SEQ ID NO: 612)
NWVNVISDLKKIEDLIQSMHIDATLYTESDVHPSCKVTAMKCFLLELQCISLESGDASIHDTVENLIILANNSLS
SNGNVTESGCKECEELEEKNIKEFLQSFVHIVQMFINTS Chain 2 - empty-Fc(216)_IgG1_pI(-)_Isosteric_A_C220S/PVA_/S267K/L368D/K370S (8793) (SEQ ID NO: 613)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 3 - human_IL15Ra(Sushi-S40C)_(GGGGS)1_Fc(216)_IgG1_C220S/PVA_/S267K/S364K/E357Q (17044) (SEQ ID NOS 614-616)
ITCPPPMSVEHADIWVKSYSLYSRERYICNSGFKRKAGTCSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 104P

\>XENP022361 – empty-Fc-IL15_L52C-human_IL15Ra(Sushi-S40C)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_L52C_no_tag (17072) (SEQ ID NO: 617)
NWVNVISDLKKIEDLIQSMHIDATLYTESDVHPSCKVTAMKCFLLELQVISCESGDASIHDTVENLIILANNSLS
SNGNVTESGCKECEELEEKNIKEFLQSFVHIVQMFINTS Chain 2 - empty-Fc(216)_IgG1_pI(-)_Isosteric_A_C220S/PVA_/S267K/L368D/K370S (8793) (SEQ ID NO: 618)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 3 - human_IL15Ra(Sushi-S40C)_(GGGGS)1_Fc(216)_IgG1_C220S/PVA_/S267K/S364K/E357Q (17044)
(SEQ ID NOS 619-621)
ITCPPPMSVEHADIWVKSYSLYSRERYICNSGFKRKAGTCSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK \>XENP022362 – empty-Fc-IL15_E89C-human_IL15Ra(Sushi-K34C)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_E89C_no_tag (17075) (SEQ ID NO: 622)
NWVNVISDLKKIEDLIQSMHIDATLYTESDVHPSCKVTAMKCFLLELQVISLESGDASIHDTVENLIILANNSLS
SNGNVTESGCKECCELEEKNIKEFLQSFVHIVQMFINTS Chain 2 - empty-Fc(216)_IgG1_pI(-)_Isosteric_A_C220S/PVA_/S267K/L368D/K370S (8793) (SEQ ID NO: 623)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 3 - human_IL15Ra(Sushi-K34C)_(GGGGS)1_Fc(216)_IgG1_C220S/PVA_/S267K/S364K/E357Q (17041)
(SEQ ID NOS 624-626)
ITCPPPMSVEHADIWVKSYSLYSRERYICNSGFCRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 104Q

>XENP022363 – empty-Fc-IL15_Q48C-human_IL15Ra(Sushi-G38C)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_Q48C_no_tag (17070) (SEQ ID NO: 627)
NWVNVISDLKKIEDLIQSMHIDATLYTESDVHPSCKVTAMKCFLLELCVISLESGDASIHDTVENLIILANNSLS
SNGNVTESGCKECEELEEKNIKEFLQSFVHIVQMFINTS Chain 2 - empty-Fc(216)_IgG1_pI(-)_Isosteric_A_C220S/PVA_/S267K/L368D/K370S (8793) (SEQ ID NO: 628)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 3 - human_IL15Ra(Sushi-G38C)_(GGGGS)1_Fc(216)_IgG1_C220S/PVA_/S267K/S364K/E357Q (17043)
(SEQ ID NOS 629-631)
ITCPPPMSVEHADIWVKSYSLYSRERYICNSGFKRKACTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022364 – empty-Fc-IL15_E53C-human_IL15Ra(Sushi-L42C)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_E53C_no_tag (17073) (SEQ ID NO: 632)
NWVNVISDLKKIEDLIQSMHIDATLYTESDVHPSCKVTAMKCFLLELQVISLCSGDASIHDTVENLIILANNSLS
SNGNVTESGCKECEELEEKNIKEFLQSFVHIVQMFINTS Chain 2 - empty-Fc(216)_IgG1_pI(-)_Isosteric_A_C220S/PVA_/S267K/L368D/K370S (8793) (SEQ ID NO: 633)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 3 - human_IL15Ra(Sushi-L42C)_(GGGGS)1_Fc(216)_IgG1_C220S/PVA_/S267K/S364K/E357Q (17045)
(SEQ ID NOS 634-636)
ITCPPPMSVEHADIWVKSYSLYSRERYICNSGFKRKAGTSSCTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 104R

>XENP022365 – empty-Fc-IL15_C42S-human_IL15Ra(Sushi-A37C)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_C42S_no_tag (17083) (SEQ ID NO: 637)
NWVNVISDLKKIEDLIQSMHIDATLYTESDVHPSCKVTAMKSFLLELQVISLESGDASIHDTVENLIILANNSLS
SNGNVTESGCKECEELEEKNIKEFLQSFVHIVQMFINTS

Chain 2 - empty-Fc(216)_IgG1_pI(-)_Isosteric_A_C220S/PVA_/S267K/L368D/K370S (8793) (SEQ ID NO: 638)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi-A37C)_(GGGGS)1_Fc(216)_IgG1_C220S/PVA_/S267K/S364K/E357Q (17042) (SEQ ID NOS 639-641)
ITCPPPMSVEHADIWVKSYSLYSRERYICNSGFKRKCGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

>XENP022366 – empty-Fc-IL15(non-covalent)-human_IL15Ra(sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_no_tag (16484) (SEQ ID NO: 642)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Chain 2 - empty-Fc(216)_IgG1_pI(-)_Isosteric_A_C220S/PVA_/S267K/L368D/K370S (8793) (SEQ ID NO: 643)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi)_(GGGGS)1_Fc(216)_IgG1_C220S/PVA_/S267K/S364K/E357Q (15908) (SEQ ID NOS 644-646)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

>XENP022493 - human_IL15_L45C-human_IL15Ra(Sushi-G38C)-6x-His

Chain 1 - human_IL15_L45C_no_tag (17069) (SEQ ID NO: 647)
NWVNVISDLKKIEDLIQSMHIDATLYTESDVHPSCKVTAMKCFLCELQVISLESGDASIHDTVENLIILANNSLS
SNGNVTESGCKECEELEEKNIKEFLQSFVHIVQMFINTS

Chain 2 - human_IL15Ra(Sushi-G38C)-6x-His (17056) (SEQ ID NO: 648)
ITCPPPMSVEHADIWVKSYSLYSRERYICNSGFKRKACTSSLTECVLNKATNVAHWTTPSLKCIR

Figure 104S

>XENP022494 – human_IL15_L45C-human_IL15Ra(Sushi-A37C)-6x-His
Chain 1 - human_IL15_L45C_no_tag (17069) (SEQ ID NO: 649)
NWVNVISDLKKIEDLIQSMHIDATLYTESDVHPSCKVTAMKCFLCELQVISLESGDASIHDTVENLIILANNSLS
SNGNVTESGCKECEELEEKNIKEFLQSFVHIVQMFINTS

Chain 2 - human_IL15Ra(Sushi-A37C)-6x-His (17055) (SEQ ID NO: 650)
ITCPPPMSVEHADIWVKSYSLYSRERYICNSGFKRKCGTSSLTECVLNKATNVAHWTTPSLKCIR

>XENP022634 – human_IL15(E87C)-human_IL15Ra(Sushi-D96/C97)_Fc(216)_IgG1_C220S/PVA_/S267K

Chain 1 - human_IL15Ra(Sushi-D96/C97)-Fc(216)_IgG1_C220S/PVA_/S267K (17581)
ITCPPPMSVEHADIWVKSYSLYSRERYICNSGFKRKAGTSSLTECVLNKATNVAHWTTPSLKCIRDC/EPKSSDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NOS 651-653)

Chain 2 - human_IL15_E87C_no_tag (17074) (SEQ ID NO: 654)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

>XENP022635 – human_IL15(E87C)-human_IL15Ra(Sushi-D96/C97/A98)_Fc(216)_IgG1_C220S/PVA_/S267K

Chain 1 - human_IL15Ra(Sushi-D96/C97/A98)-Fc(216)_IgG1_C220S/PVA_/S267K (17582) (SEQ ID NOS 655-657)
ITCPPPMSVEHADIWVKSYSLYSRERYICNSGFKRKAGTSSLTECVLNKATNVAHWTTPSLKCIRDCA/EPKSSD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK

Chain 2 - human_IL15_E87C_no_tag (17074) (SEQ ID NO: 658)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

>XENP022636 – human_IL15(L52C)-human_IL15Ra(Sushi-S40C)_Fc(216)_IgG1_C220S/PVA_/S267K

Chain 1 - human_IL15Ra(Sushi-S40C)-Fc(216)_IgG1_C220S/PVA_/S267K (17583) (SEQ ID NOS 659-661)
ITCPPPMSVEHADIWVKSYSLYSRERYICNSGFKRKAGTCSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Chain 2 - human_IL15_L52C_no_tag (17072) (SEQ ID NO: 662)
NWVNVISDLKKIEDLIQSMHIDATLYTESDVHPSCKVTAMKCFLLELQVISCESGDASIHDTVENLIILANNSLS
SNGNVTESGCKECEELEEKNIKEFLQSFVHIVQMFINTS

Figure 104T

>XENP022637 – empty-Fc(216)_IgG1_pI(-
)_Isosteric_A_C220S/PVA_/S267K/L368D/K370S_(GGGGS)2_IL15Ra(Sushi)_IL15(non-
covalent)_IgG1_ISO(+RR)_C220S/PVA_/S267K/S364K/E357Q Chain 1 - empty-Fc(216)_IgG1_pI(-)_Isosteric_A_C220S/PVA_/S267K/L368D/K370S_(GGGGS)2_IL15Ra(Sushi)
(17603) (SEQ ID NOS 663-665)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIR Chain 2 - empty-Fc(216)_IgG1_ISO(+RR)_C220S/PVA_/S267K/S364K/E357Q (8927) (SEQ ID NO: 666)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK Chain 3 - human_IL15_no_tag (16484) (SEQ ID NO: 667)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS >XENP022638 empty-Fc(216)_IgG1_pI(-
)_Isosteric_A_C220S/PVA_/S267K/L368D/K370S_IgG1_ISO(+RR)_C220S/PVA_/S267K/S364K/E357Q_(GGGGS
)2_IL15Ra(Sushi)_IL15(non-covalent)

Chain 1 - IL15 (SEQ ID NO: 668)
NWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS Chain 2 – empty_Fc(216)_IgG1_pI(-)_Isosteric_A_C220S/PVA_/S267K/L368D/K370S (SEQ ID NO: 669)
EPKSSDKTHTCPPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDGQPENNYKTTPP
VLDSDGSFFLYSKLTVDKSRWEQGDVFSCSVMHEALHNHYTQKSLSLSPGK Chain 3 – Fc(216)_IgG1_ISO(+RR)_C220S/PVA_/S267K/S364K/E357Q_(GGGGS)2_IL15Ra(Sushi) (SEQ ID NOS
670-672)
ERKSSDKTHTCPRCPAPPVAGPSVFLFPPKPKDTLMISRTPEVTCVVVDVKHEDPEVKFKWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWESNGQPENNYKTTPP
VLDSDGSFFLYSKLTVDKSRWQQGNVFSCSVMHEALHNHYTQKSLSLSPGK/GGGGSGGGGS/ITCPPPMSVEHADIWVKSYSLYSRERY
ICNSGFKRKAGTSSLTECVLNKATNVAHWTTPSLKCIR

Figure 104U

>XENP022639 – empty-Fc(216)_IgG1_pI(-
)_Isosteric_A_C220S/PVA_/S267K/L368D/K370S_(GGGGS)2_IL15Ra(Sushi-
D96/C97)_IL15(E87C)_IgG1_ISO(+RR)_C220S/PVA_/S267K/S364K/E357Q Chain 1 - empty-Fc(216)_IgG1_pI(-)_Isosteric_A_C220S/PVA_/S267K/L368D/K370S_(GGGGS)2_IL15Ra(Sushi-
D96/C97) (17605) (SEQ ID NOS 673-675)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIRDC Chain 2 - empty-Fc(216)_IgG1_ISO(+RR)_C220S/PVA_/S267K/S364K/E357Q (8927) (SEQ ID NO: 676)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK Chain 3 - human_IL15_E87C_no_tag (17074) (SEQ ID NO: 677)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS >XENP022640 empty-Fc(216)_IgG1_pI(-
)_Isosteric_A_C220S/PVA_/S267K/L368D/K370S_IgG1_ISO(+RR)_C220S/PVA_/S267K/S364K/E357Q_(GGGGS
)2_IL15Ra(Sushi-D96/C97)_IL15(E87C)

Chain 1 – IL15 (SEQ ID NO: 678)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS Chain 2 – empty_Fc(216)_IgG1_pI(-)_Isosteric_A_C220S/PVA_/S267K/L368D/K370S (SEQ ID NO: 679)
EPKSSDKTHTCPPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDGQPENNYKTTPP
VLDSDGSFFLYSKLTVDKSRWEQGDVFSCSVMHEALHNHYTQKSLSLSPGK >XENP022684 empty-Fc-IL15_E87C-human_IL15Ra(Sushi-D96/C97/A98)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – IL15_E87C (SEQ ID NO: 680)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS Chain 2 - IL15Ra(Sushi-D96/C97/A98)_Fc(216)_IgG1_pI(-)_Isosteric_A_C220S/PVA_/S267K/L368D/K370S
(SEQ ID NOS 681-683)
ITCPPPMSVEHADIWVKSYSLYSRERYICNSGFKRKAGTSSLTECVLNKATNVAHWTTPSLKCIRDCA/EPKSSDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLNGKEYKCKVSNKA
LPAPIEKTISKAKGQPREPQVYTLPPSREQMTKNQVKLTCLVKGFYPSDIAVEWESNGQPENNYKTTPPVLDSDGSFFLYSKLTVDKSRW
QQGNVFSCSVMHEALHNHYTQKSLSLSPGK Chain 3 – empty_Fc(216)_IgG1_C220S/PVA_/S267K/S364K/E357Q (SEQ ID NO: 684)
EPKSSDKTHTCPPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDGQPENNYKTTPP
VLDSDGSFFLYSKLTVDKSRWEQGDVFSCSVMHEALHNHYTQKSLSLSPGK

Figure 104V

>XENP022687 human_IL15_E87C-human_IL15Ra(Sushi-D96/C97/A98)_Fc(216)_IgG1_C220S/PVA_/S267K

Chain 1 – IL15_E87C (SEQ ID NO: 685)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS

Chain 2 - IL15Ra(Sushi-D96/C97/A98)_Fc(216)_IgG1_C220S/PVA_/S267K (SEQ ID NOS 686-688)
ITCPPPMSVEHADIWVKSYSLYSRERYICNSGFKRKAGTSSLTECVLNKATNVAHWTTPSLKCIRDCA/EPKSSDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLNGKEYKCKVSNKA
LPAPIEKTISKAKGQPREPQVYTLPPSREEMTKNQVSLTCLVKGFYPSDIAVEWESNGQPENNYKTTPPVLDSDGSFFLYSKLTVDKSRW
QQGNVFSCSVMHEALHNHYTQKSLSLSPGK >XENP022791 - human_IL15_N1D(non-covalent)-human_IL15Rα(Sushi)-6x-His

Chain 1 - human_IL15_N1D(non-covalent) (17666) (SEQ ID NO: 689)
DWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Chain 2 - human_IL15Rα(Sushi)-6x-His (17033) (SEQ ID NO: 690)
ITCPPPMSVEHADIWVKSYSLYSRERYICNSGFKRKAGTSSLTECVLNKATNVAHWTTPSLKCIR >XENP022792 - human_IL15_N4D(non-covalent)-human_IL15Rα(Sushi)-6x-His

Chain 1 - human_IL15_N4D(non-covalent) (17667) (SEQ ID NO: 691)
NWVDVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Chain 2 - human_IL15Rα(Sushi)-6x-His (17033) (SEQ ID NO: 692)
ITCPPPMSVEHADIWVKSYSLYSRERYICNSGFKRKAGTSSLTECVLNKATNVAHWTTPSLKCIR >XENP022793 - human_IL15_D8N(non-covalent)-human_IL15Rα(Sushi)-6x-His

Chain 1 - human_IL15_D8N(non-covalent) (17668) (SEQ ID NO: 693)
NWVNVISNLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Chain 2 - human_IL15Rα(Sushi)-6x-His (17033) (SEQ ID NO: 694)
ITCPPPMSVEHADIWVKSYSLYSRERYICNSGFKRKAGTSSLTECVLNKATNVAHWTTPSLKCIR >XENP022794 - human_IL15_D30N(non-covalent)-human_IL15Rα(Sushi)-6x-His

Chain 1 - human_IL15_D30N(non-covalent) (17669) (SEQ ID NO: 695)
NWVNVISDLKKIEDLIQSMHIDATLYTESNVHPSCKVTAMKCFLLELQVISLESGDASIHDTVENLIILANNSLS
SNGNVTESGCKECEELEEKNIKEFLQSFVHIVQMFINTS

Chain 2 - human_IL15Rα(Sushi)-6x-His (17033) (SEQ ID NO: 696)
ITCPPPMSVEHADIWVKSYSLYSRERYICNSGFKRKAGTSSLTECVLNKATNVAHWTTPSLKCIR

Figure 104W

>XENP022795 - human_IL15_D61N(non-covalent)-human_IL15Rα(Sushi)-6x-His

Chain 1 - human_IL15_D61N(non-covalent) (17670) (SEQ ID NO: 697)
NWVNVISDLKKIEDLIQSMHIDATLYTESDVHPSCKVTAMKCFLLELQVISLESGDASIHNTVENLIILANNSLS
SNGNVTESGCKECEELEEKNIKEFLQSFVHIVQMFINTS

Chain 2 - human_IL15Rα(Sushi)-6x-His (17033) (SEQ ID NO: 698)
ITCPPPMSVEHADIWVKSYSLYSRERYICNSGFKRKAGTSSLTECVLNKATNVAHWTTPSLKCIR

>XENP022796 - human_IL15_E64Q(non-covalent)-human_IL15Rα(Sushi)-6x-His

Chain 1 - human_IL15_E64Q(non-covalent) (17671) (SEQ ID NO: 699)
NWVNVISDLKKIEDLIQSMHIDATLYTESDVHPSCKVTAMKCFLLELQVISLESGDASIHDTVQNLIILANNSLS
SNGNVTESGCKECEELEEKNIKEFLQSFVHIVQMFINTS

Chain 2 - human_IL15Rα(Sushi)-6x-His (17033) (SEQ ID NO: 700)
ITCPPPMSVEHADIWVKSYSLYSRERYICNSGFKRKAGTSSLTECVLNKATNVAHWTTPSLKCIR

>XENP022801 - human_IL15_N65D(non-covalent)-human_IL15Rα(Sushi)-6x-His

Chain 1 - human_IL15_N65D(non-covalent) (17672) (SEQ ID NO: 701)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS

Chain 2 - human_IL15Rα(Sushi)-6x-His (17033) (SEQ ID NO: 702)
ITCPPPMSVEHADIWVKSYSLYSRERYICNSGFKRKAGTSSLTECVLNKATNVAHWTTPSLKCIR

>XENP022802 - human_IL15_Q108E(non-covalent)-human_IL15Rα(Sushi)-6x-His

Chain 1 - human_IL15_Q108E(non-covalent) (17673) (SEQ ID NO: 703)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS

Chain 2 - human_IL15Rα(Sushi)-6x-His (17033) (SEQ ID NO: 704)
ITCPPPMSVEHADIWVKSYSLYSRERYICNSGFKRKAGTSSLTECVLNKATNVAHWTTPSLKCIR

>XENP022803 - human_IL15_N1D/D61N(non-covalent)-human_IL15Rα(Sushi)-6x-His

Chain 1 - human_IL15_N1D/D61N(non-covalent) (17674) (SEQ ID NO: 705)
DWVNVISDLKKIEDLIQSMHIDATLYTESDVHPSCKVTAMKCFLLELQVISLESGDASIHNTVENLIILANNSLS
SNGNVTESGCKECEELEEKNIKEFLQSFVHIVQMFINTS

Chain 2 - human_IL15Rα(Sushi)-6x-His (17033) (SEQ ID NO: 706)
ITCPPPMSVEHADIWVKSYSLYSRERYICNSGFKRKAGTSSLTECVLNKATNVAHWTTPSLKCIR

Figure 104X

>XENP022804 - human_IL15_N1D/E64Q(non-covalent)-human_IL15Rα(Sushi)-6x-His

Chain 1 - human_IL15_N1D/E64Q(non-covalent) (17675) (SEQ ID NO: 707)
DWVNVISDLKKIEDLIQSMHIDATLYTESDVHPSCKVTAMKCFLLELQVISLESGDASIHDTVQNLIILANNSLS
SNGNVTESGCKECEELEEKNIKEFLQSFVHIVQMFINTS Chain 2 - human_IL15Rα(Sushi)-6x-His (17033) (SEQ ID NO: 708)
ITCPPPMSVEHADIWVKSYSLYSRERYICNSGFKRKAGTSSLTECVLNKATNVAHWTTPSLKCIR

>XENP022805 - human_IL15_N4D/D61N(non-covalent)-human_IL15Rα(Sushi)-6x-His

Chain 1 - human_IL15_N4D/D61N(non-covalent) (17676) (SEQ ID NO: 709)
NWVDVISDLKKIEDLIQSMHIDATLYTESDVHPSCKVTAMKCFLLELQVISLESGDASIHNTVENLIILANNSLS
SNGNVTESGCKECEELEEKNIKEFLQSFVHIVQMFINTS Chain 2 - human_IL15Rα(Sushi)-6x-His (17033) (SEQ ID NO: 710)
ITCPPPMSVEHADIWVKSYSLYSRERYICNSGFKRKAGTSSLTECVLNKATNVAHWTTPSLKCIR

>XENP022806 - human_IL15_N4D/E64Q(non-covalent)-human_IL15Rα(Sushi)-6x-His

Chain 1 - human_IL15_N4D/E64Q(non-covalent) (17677) (SEQ ID NO: 711)
NWVDVISDLKKIEDLIQSMHIDATLYTESDVHPSCKVTAMKCFLLELQVISLESGDASIHDTVQNLIILANNSLS
SNGNVTESGCKECEELEEKNIKEFLQSFVHIVQMFINTS Chain 2 - human_IL15Rα(Sushi)-6x-His (17033) (SEQ ID NO: 712)
ITCPPPMSVEHADIWVKSYSLYSRERYICNSGFKRKAGTSSLTECVLNKATNVAHWTTPSLKCIR

>XENP022807 - human_IL15_D8N/D61N(non-covalent)-human_IL15Rα(Sushi)-6x-His

Chain 1 - human_IL15_D8N/D61N(non-covalent) (17678) (SEQ ID NO: 713)
NWVNVISNLKKIEDLIQSMHIDATLYTESDVHPSCKVTAMKCFLLELQVISLESGDASIHNTVENLIILANNSLS
SNGNVTESGCKECEELEEKNIKEFLQSFVHIVQMFINTS Chain 2 - human_IL15Rα(Sushi)-6x-His (17033) (SEQ ID NO: 714)
ITCPPPMSVEHADIWVKSYSLYSRERYICNSGFKRKAGTSSLTECVLNKATNVAHWTTPSLKCIR

>XENP022808 - human_IL15_D8N/E64Q(non-covalent)-human_IL15Rα(Sushi)-6x-His

Chain 1 - human_IL15_D8N/E64Q(non-covalent) (17679) (SEQ ID NO: 715)
NWVNVISNLKKIEDLIQSMHIDATLYTESDVHPSCKVTAMKCFLLELQVISLESGDASIHDTVQNLIILANNSLS
SNGNVTESGCKECEELEEKNIKEFLQSFVHIVQMFINTS Chain 2 - human_IL15Rα(Sushi)-6x-His (17033) (SEQ ID NO: 716)
ITCPPPMSVEHADIWVKSYSLYSRERYICNSGFKRKAGTSSLTECVLNKATNVAHWTTPSLKCIR

Figure 104Y

>XENP022809 - human_IL15_D61N/E64Q(non-covalent)-human_IL15Rα(Sushi)-6x-His

Chain 1 - human_IL15_D61N/E64Q(non-covalent) (17680) (SEQ ID NO: 717)
NWVNVISDLKKIEDLIQSMHIDATLYTESDVHPSCKVTAMKCFLLELQVISLESGDASIHNTVQNLIILANNSLS
SNGNVTESGCKECEELEEKNIKEFLQSFVHIVQMFINTS Chain 2 - human_IL15Rα(Sushi)-6x-His (17033) (SEQ ID NO: 718)
ITCPPPMSVEHADIWVKSYSLYSRERYICNSGFKRKAGTSSLTECVLNKATNVAHWTTPSLKCIR >XENP022810 - human_IL15_E64Q/Q108E(non-covalent)-human_IL15Rα(Sushi)-6x-His Chain 1 - human_IL15_E64Q/Q108E(non-covalent) (17681) (SEQ ID NO: 719)
NWVNVISDLKKIEDLIQSMHIDATLYTESDVHPSCKVTAMKCFLLELQVISLESGDASIHDTVQNLIILANNSLS
SNGNVTESGCKECEELEEKNIKEFLQSFVHIVEMFINTS Chain 2 - human_IL15Rα(Sushi)-6x-His (17033) (SEQ ID NO: 720)
ITCPPPMSVEHADIWVKSYSLYSRERYICNSGFKRKAGTSSLTECVLNKATNVAHWTTPSLKCIR >XENP022811 - human_IL15_N1D/N4D/D8N(non-covalent)-human_IL15Rα(Sushi)-6x-His Chain 1 - human_IL15_N1D/N4D/D8N(non-covalent) (17682) (SEQ ID NO: 721)
DWVDVISNLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS Chain 2 - human_IL15Rα(Sushi)-6x-His (17033) (SEQ ID NO: 722)
ITCPPPMSVEHADIWVKSYSLYSRERYICNSGFKRKAGTSSLTECVLNKATNVAHWTTPSLKCIR >XENP022812 - human_IL15_D61N/E64Q/N65D(non-covalent)-human_IL15Rα(Sushi)-6x-His Chain 1 - human_IL15_D61N/E64Q/N65D(non-covalent) (17683) (SEQ ID NO: 723)
NWVNVISDLKKIEDLIQSMHIDATLYTESDVHPSCKVTAMKCFLLELQVISLESGDASIHNTVQDLIILANNSLS
SNGNVTESGCKECEELEEKNIKEFLQSFVHIVQMFINTS Chain 2 - human_IL15Rα(Sushi)-6x-His (17033) (SEQ ID NO: 724)
ITCPPPMSVEHADIWVKSYSLYSRERYICNSGFKRKAGTSSLTECVLNKATNVAHWTTPSLKCIR >XENP022813 - human_IL15_N1D/D61N/E64Q/Q108E(non-covalent)-human_IL15Rα(Sushi)-6x-His Chain 1 - human_IL15_N1D/D61N/E64Q/Q108E(non-covalent) (17684) (SEQ ID NO: 725)
DWVNVISDLKKIEDLIQSMHIDATLYTESDVHPSCKVTAMKCFLLELQVISLESGDASIHNTVQNLIILANNSLS
SNGNVTESGCKECEELEEKNIKEFLQSFVHIVEMFINTS Chain 2 - human_IL15Rα(Sushi)-6x-His (17033) (SEQ ID NO: 726)
ITCPPPMSVEHADIWVKSYSLYSRERYICNSGFKRKAGTSSLTECVLNKATNVAHWTTPSLKCIR

Figure 104Z

>XENP022814 - human_IL15_N4D/D61N/E64Q/Q108E(non-covalent)-human_IL15Rα(Sushi)-6x-His

Chain 1 - human_IL15_N4D/D61N/E64Q/Q108E(non-covalent) (17685) (SEQ ID NO: 727)
NWVDVISDLKKIEDLIQSMHIDATLYTESDVHPSCKVTAMKCFLLELQVISLESGDASIHNTVQNLIILANNSLS
SNGNVTESGCKECEELEEKNIKEFLQSFVHIVEMFINTS Chain 2 - human_IL15Rα(Sushi)-6x-His (17033) (SEQ ID NO: 728)
ITCPPPMSVEHADIWVKSYSLYSRERYICNSGFKRKAGTSSLTECVLNKATNVAHWTTPSLKCIR

>XENP022815 - human_IL15_N1D_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_N1D_(GGGGS)₁ (17686) (SEQ ID NOS 729-731)
DWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908) (SEQ ID NOS 732-734)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

>XENP022816 - human_IL15_N4D_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_N4D_(GGGGS)₁ (17687) (SEQ ID NOS 735-737)
NWVDVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908) (SEQ ID NOS 738-740)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 104AA

>XENP022817 - human_IL15_D8N_(GGGGS)₁-human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_D8N_(GGGGS)₁ (17688) (SEQ ID NOS 741-743)
NWVNVISNLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q (15908)
(SEQ ID NOS 744-746)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022818 - human_IL15_D30N_(GGGGS)₁-human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_D30N_(GGGGS)₁ (17689) (SEQ ID NOS 747-749)
NWVNVISDLKKIEDLIQSMHIDATLYTESNVHPSCKVTAMKCFLLELQVISLESGDASIHDTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q (15908)
(SEQ ID NOS 750-752)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 104AB

>XENP022819 - human_IL15_D61N_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_D61N_(GGGGS)₁ (17690) (SEQ ID NOS 753-755)
NWVNVISDLKKIEDLIQSMHIDATLYTESDVHPSCKVTAMKCFLLELQVISLESGDASIHNTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908) (SEQ ID NOS 756-758)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022820 - human_IL15_E64Q_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_E64Q_(GGGGS)₁ (17691) (SEQ ID NOS 759-761)
NWVNVISDLKKIEDLIQSMHIDATLYTESDVHPSCKVTAMKCFLLELQVISLESGDASIHDTVQNLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908) (SEQ ID NOS 762-764)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022821 - human_IL15_N65D_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_N65D_(GGGGS)₁ (17692) (SEQ ID NOS 765-767)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908) (SEQ ID NOS 768-770)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 104AC

>XENP022822 - human_IL15_Q108E_(GGGGS)₁-human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_Q108E_(GGGGS)₁ (17693) (SEQ ID NOS 771-773)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q (15908)
(SEQ ID NOS 774-776)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022823 - human_IL15_N1D/D61N_(GGGGS)₁-human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_N1D/D61N_(GGGGS)₁ (17694) (SEQ ID NOS 777-779)
DWVNVISDLKKIEDLIQSMHIDATLYTESDVHPSCKVTAMKCFLLELQVISLESGDASIHNTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q (15908)
(SEQ ID NOS 780-782)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022824 - human_IL15_N1D/E64Q_(GGGGS)₁-human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_N1D/E64Q_(GGGGS)₁ (17695) (SEQ ID NOS 783-785)
DWVNVISDLKKIEDLIQSMHIDATLYTESDVHPSCKVTAMKCFLLELQVISLESGDASIHDTVQNLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q (15908)
(SEQ ID NOS 786-788)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 104AD

>XENP022825 - human_IL15_N4D/D61N_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_N4D/D61N_(GGGGS)₁ (17696) (SEQ ID NOS 789-791)
NWVDVISDLKKIEDLIQSMHIDATLYTESDVHPSCKVTAMKCFLLELQVISLESGDASIHNTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908) (SEQ ID NOS 792-794)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022826 - human_IL15_N4D/E64Q_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_N4D/E64Q_(GGGGS)₁ (17697) (SEQ ID NOS 795-797)
NWVDVISDLKKIEDLIQSMHIDATLYTESDVHPSCKVTAMKCFLLELQVISLESGDASIHDTVQNLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908) (SEQ ID NOS 798-800)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022827 - human_IL15_D8N/D61N_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_D8N/D61N_(GGGGS)₁ (17698) (SEQ ID NOS 801-803)
NWVNVISNLKKIEDLIQSMHIDATLYTESDVHPSCKVTAMKCFLLELQVISLESGDASIHNTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908) (SEQ ID NOS 804-806)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 104AE

>XENP022828 - human_IL15_D8N/E64Q_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_D8N/E64Q_(GGGGS)₁ (17699) (SEQ ID NOS 807-809)
NWVNVISNLKKIEDLIQSMHIDATLYTESDVHPSCKVTAMKCFLLELQVISLESGDASIHDTVQNLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908)
(SEQ ID NOS 810-812)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022829 - human_IL15_D61N/E64Q_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_D61N/E64Q_(GGGGS)₁ (17700) (SEQ ID NOS 813-815)
NWVNVISDLKKIEDLIQSMHIDATLYTESDVHPSCKVTAMKCFLLELQVISLESGDASIHNTVQNLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908)
(SEQ ID NOS 816-818)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022830 - human_IL15_E64Q/Q108E_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_E64Q/Q108E_(GGGGS)₁ (17701) (SEQ ID NOS 819-821)
NWVNVISDLKKIEDLIQSMHIDATLYTESDVHPSCKVTAMKCFLLELQVISLESGDASIHDTVQNLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908)
(SEQ ID NOS 822-824)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 104AF

<u>>XENP022831 - human_IL15_N1D/N4D/D8N_(GGGGS)₁-
human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q</u>

Chain 1 - human_IL15_N1D/N4D/D8N_(GGGGS)₁ (17702) (SEQ ID NOS 825-827)
DWVDVISNLKKIEDLIQSMHIDATLYTESDVHPSCKVTAMKCFLLELQVISLESGDASIHDTVENLII
LANNSLSSNGNVTESGCKECEELEEKNIKEFLQSFVHIVQMFINTS/<u>GGGGS</u>/EPKSSDKTHTCPPCP
APPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTC
DVSGFYPSDIAVEWESDGQPENNYKTTPPVLDSDGSFFLYSKLTVDKSRWEQGDVFSCSVMHEALHNH
YTQKSLSLSPGK

**Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q
(15908) (SEQ ID NOS 828-830)**
ITCPPPMSVEHADIWVKSYSLYSRERYICNSGFKRKAGTSSLTECVLNKATNVAHWTTPSLKCIR/<u>GG
GGS</u>/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQV
YTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK <u>>XENP022832 - human_IL15_D61N/E64Q/N65D_(GGGGS)₁-
human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q</u>

Chain 1 - human_IL15_D61N/E64Q/N65D_(GGGGS)₁ (17703) (SEQ ID NOS 831-833)
NWVNVISDLKKIEDLIQSMHIDATLYTESDVHPSCKVTAMKCFLLELQVISLESGDASIHNTVQDLII
LANNSLSSNGNVTESGCKECEELEEKNIKEFLQSFVHIVQMFINTS/<u>GGGGS</u>/EPKSSDKTHTCPPCP
APPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTC
DVSGFYPSDIAVEWESDGQPENNYKTTPPVLDSDGSFFLYSKLTVDKSRWEQGDVFSCSVMHEALHNH
YTQKSLSLSPGK

**Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q
(15908) (SEQ ID NOS 834-836)**
ITCPPPMSVEHADIWVKSYSLYSRERYICNSGFKRKAGTSSLTECVLNKATNVAHWTTPSLKCIR/<u>GG
GGS</u>/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQV
YTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK

Figure 104AF (continued)

<u>>XENP022833 - human_IL15_N1D/D61N/E64Q/Q108E_(GGGGS)₁-
human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q</u>

Chain 1 - human_IL15_N1D/D61N/E64Q/Q108E_(GGGGS)₁ (17704) (SEQ ID NOS 837-839)
<u>DWVNVISDLKKIEDLIQSMHIDATLYTESDVHPSCKVTAMKCFLLELQVISLESGDASIHNTVQNLII
LANNSLSSNGNVTESGCKECEELEEKNIKEFLQSFVHIVEMFINTS</u>/<u>GGGGS</u>/EPKSSDKTHTCPPCP
APPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTC
DVSGFYPSDIAVEWESDGQPENNYKTTPPVLDSDGSFFLYSKLTVDKSRWEQGDVFSCSVMHEALHNH
YTQKSLSLSPGK

**Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q (15908)
(SEQ ID NOS 840-842)**
<u>ITCPPPMSVEHADIWVKSYSLYSRERYICNSGFKRKAGTSSLTECVLNKATNVAHWTTPSLKCIR</u>/<u>GGGGS</u>/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 104AG

>XENP022834 - human_IL15_N4D/D61N/E64Q/Q108E_(GGGGS)₁-
human_IL15Rα(Sushi)_(GGGGS)₁_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15_N4D/D61N/E64Q/Q108E_(GGGGS)₁ (17705) (SEQ ID NOS 843-845)
NWVDVISDLKKIEDLIQSMHIDATLYTESDVHPSCKVTAMKCFLLELQVISLESGDASIHNTVQNLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q (15908)
(SEQ ID NOS 846-848)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP023174 human_IL15Rα(sushi)_(GKPGS)6-human_IL15(single-chain)-empty-Fc_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15Rα(sushi)_(GKPGS)6-human_IL15(single-chain)_Fc(216)_IgG1_pI(-
)_Isosteric_A_C220S/PVA_/S267K/L368D/K370S (SEQ ID NOS 849-852)
ITCPPPMSVEHADIWVKSYSLYSRERYICNSGFKRKAGTSSLTECVLNKATNVAHWTTPSLKCIR/GKPGSGKPGSGKPGSGKPGSGKPG
SGKPGS/NWVNVISDLKKIEDLIQSMHIDATLYTESDVHPSCKVTAMKCFLLELQVISLESGDASIHDTVENLIILANNSLSSNGNVTES
GCKECEELEEKNIKEFLQSFVHIVQMFINTS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVYTLPPSREEMTKNQVS
LTCDVSGFYPSDIAVEWESDGQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 853)
EPKSSDKTHTCPPCPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWESNGQPENNYKTTPP
VLDSDGSFFLYSKLTVDKSRWQQGNVFSCSVMHEALHNHYTQKSLSLSPGK >XENP023175 human_IL15Rα(sushi)_(GKPGS)5-human_IL15(single-chain)-empty-Fc_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15Rα(sushi)_(GKPGS)5-human_IL15(single-chain)_Fc(216)_IgG1_pI(-
)_Isosteric_A_C220S/PVA_/S267K/L368D/K370S (SEQ ID NOS 854-857)
ITCPPPMSVEHADIWVKSYSLYSRERYICNSGFKRKAGTSSLTECVLNKATNVAHWTTPSLKCIR/GKPGSGKPGSGKPGSGKPGSGKPG
S/NWVNVISDLKKIEDLIQSMHIDATLYTESDVHPSCKVTAMKCFLLELQVISLESGDASIHDTVENLIILANNSLSSNGNVTESGCKEC
EELEEKNIKEFLQSFVHIVQMFINTS/EPKSSDKTHTCPPCPAPPVAGPSVFLFPPKPKDTLMISRTPEVTCVVVDVKHEDPEVKFNWY
DGVEVHNAKTKPREEEYNSTYRVVSVLTVLHQDWLNGKEYKCKVSNKALPAPIEKTISKAKGQPREPQVYTLPPSREEMTKNQVSLTCDV
SGFYPSDIAVEWESDGQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 858)
EPKSSDKTHTCPPCPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWESNGQPENNYKTTPP
VLDSDGSFFLYSKLTVDKSRWQQGNVFSCSVMHEALHNHYTQKSLSLSPGK

Figure 104AH

>XENP023343 - human_IL15_N65D_(GGGGS)1-human_IL15Ra(Sushi)_(GGGGS)1_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S Chain 1 - human_IL15_N65D_(GGGGS)1_Fc(216)_IgG1_pI(-
)_Isosteric_A_C220S/PVA_/S267K/L368D/K370S/M428L/N434S (18295) (SEQ ID NOS 859-861)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVLHEALHSHYTQKSLSLSPGK Chain 2 - human_IL15Ra(Sushi)_(GGGGS)1_Fc(216)_IgG1_C220S/PVA_/S267K/S364K/E357Q/M428L/N434S
(17761) (SEQ ID NOS 862-864)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK >XENP023472 empty-Fc-IL15_N65D/E87C-human_IL15Ra(Sushi-D96/C97)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – empty_Fc(216)_IgG1_pI(-)_Isosteric_A_C220S/PVA_/S267K/L368D/K370S (SEQ ID NO: 865)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 2 - IL15_N65D/E87C (SEQ ID NO: 866)
NWVNVISDLKKIEDLIQSMHIDATLYTESDVHPSCKVTAMKCFLLELQVISLESGDASIHDTVEDLIILANNSLS
SNGNVTESGCKCCEELEEKNIKEFLQSFVHIVQMFINTS Chain 3 - IL15Ra(Sushi-D96/C97)_Fc(216)_IgG1_C220S/PVA_/S267K/S364K/E357Q (SEQ ID NOS 867-869)
ITCPPPMSVEHADIWVKSYSLYSRERYICNSGFKRKAGTSSLTECVLNKATNVAHWTTPSLKCIRDC/EPKSSDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK

Figure 104AI

>XENP023473 empty-Fc-IL15_N65D/L52C-human_IL15Ra(Sushi-S40C)_Fc(216)_IgG1_pI(-)_Isosteric_A_C220S/PVA_/S267K/L368D/K370S-Fc(216)_IgG1_C220S/PVA_/S267K/S364K/E357Q Chain 1 – empty_ Fc(216)_IgG1_pI(-)_Isosteric_A_C220S/PVA_/S267K/L368D/K370S (SEQ ID NO: 870)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Chain 2 - IL15_N65D/L52C (SEQ ID NO: 871)
NWVNVISDLKKIEDLIQSMHIDATLYTESDVHPSCKVTAMKCFLLELQVISCESGDASIHDTVEDLIILANNSLS
SNGNVTESGCKECEELEEKNIKEFLQSFVHIVQMFINTS Chain 3 - IL15Ra(Sushi-S40C)_Fc(216)_IgG1_C220S/PVA_/S267K/S364K/E357Q (SEQ ID NOS 872-874)
ITCPPPMSVEHADIWVKSYSLYSRERYICNSGFKRKAGTCSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP023504 human_IL15_Q108E_(GGGGS)1-human_IL15Ra(Sushi)_(GGGGS)1_Fc(216)_IgG1_pI(-)_Isosteric_A_C220S/PVA_/S267K/L368D/K370S/M428L/N434S-Fc(216)_IgG1_C220S/PVA_/S267K/S364K/E357Q/M428L/N434S Chain 1 – human_IL15_Q108E_(GGGGS)1_Fc(216)_IgG1_pI(-)_Isosteric_A_C220S/PVA_/S267K/L368D/K370S/M428L/N434S (SEQ ID NOS 875-877)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVLHEALHSHYTQKSLSLSPGK Chain 2 – human_IL15Rα(Sushi)_(GGGGS)1_ Fc(216)_IgG1_C220S/PVA_/S267K/S364K/E357Q/M428L/N434S (SEQ ID NOS 878-880)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK >XENP023554 - human_IL15_N1D/N65D_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_N1D/N65D_(GGGGS)1_Fc(216)_IgG1_pI(-)_Isosteric_A_C220S/PVA_/S267K/L368D/K370S (18783) (SEQ ID NOS 881-883)
DWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)1_Fc(216)_IgG1_C220S/PVA_/S267K/S364K/E357Q (15908) (SEQ ID NOS 884-886)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 104AJ

>XENP023555 - human_IL15_N1D/Q108E_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_N1D/Q108E_(GGGGS)1_Fc(216)_IgG1_pI(-)_Isosteric_A_C220S/PVA_/S267K/L368D/K370S (18784) (SEQ ID NOS 887-889)
DWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (15908) (SEQ ID NOS 890-892)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP023557 - human_IL15_N4D/N65D_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_N4D/N65D_(GGGGS)1_Fc(216)_IgG1_pI(-)_Isosteric_A_C220S/PVA_/S267K/L368D/K370S (18786) (SEQ ID NOS 893-895)
NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (15908) (SEQ ID NOS 896-898)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP023559 - human_IL15_D30N/N65D_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_D30N/N65D_(GGGGS)1_Fc(216)_IgG1_pI(-)_Isosteric_A_C220S/PVA_/S267K/L368D/K370S (18788) (SEQ ID NOS 899-901)
NWVNVISDLKKIEDLIQSMHIDATLYTESNVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (15908) (SEQ ID NOS 902-904)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 104AK

>XENP023560 human_IL15_D30N/Q108E_(GGGGS)1-human_IL15Ra(Sushi)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_D30N/Q108E_(GGGGS)1_Fc(216)_IgG1_pI(-
)_Isosteric_A_C220S/PVA_/S267K/L368D/K370S (SEQ ID NOS 905-907)
NWVNVISDLKKIEDLIQSMHIDATLYTESNVHPSCKVTAMKCFLLELQVISLESGDASIHDTVENLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (SEQ ID NOS
908-910)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP023561 human_IL15_N65D/Q108E_(GGGGS)1-human_IL15Ra(Sushi)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_N65D/Q108E_(GGGGS)1_Fc(216)_IgG1_pI(-
)_Isosteric_A_C220S/PVA_/S267K/L368D/K370S (SEQ ID NOS 911-913)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (SEQ ID NOS
914-916)
ITCPPPMSVEHADIWVKSYSLYSRERYICNSGFKRKAGTSSLTECVLNKATNVAHWTTPSLKCIR/GGGGS/EPKSSDKTHTCP
PCPAPPVAGPSVFLFPPKPKDTLMISRTPEVTCVVVDVKHEDPEVKFNWYVDGVEVHNAKTKPREEQYNSTYRVV
SVLTVLHQDWLNGKEYKCKVSNKALPAPIEKTISKAKGQPREPQVYTLPPSREQMTKNQVKLTCLVKGFYPSDIA
VEWESNGQPENNYKTTPPVLDSDGSFFLYSKLTVDKSRWQQGNVFSCSVMHEALHNHYTQKSLSLSPGK >XENP024013 human_IL15Ra(sushi)_(GGGGS)5-human_IL15(D61N;single-chain)-empty-Fc_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15Ra(sushi)_(GGGGS)5-human_IL15(D61N;single-chain)_Fc(216)_IgG1_pI(-
)_Isosteric_A_C220S/PVA_/S267K/L368D/K370S (SEQ ID NOS 917-920)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHNTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 921)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 104AL

>XENP024014 human_IL15Ra(sushi)_(GGGGS)5-human_IL15(N65D;single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15(N65D;single-chain)_Fc(216)_IgG1_pI(-)_Isosteric_A_C220S/PVA_/S267K/L368D/K370S (SEQ ID NOS 922-925)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 926)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP024015 human_IL15Ra(sushi)_(GGGGS)5-human_IL15(Q108E;single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15(Q108E;single-chain)_Fc(216)_IgG1_pI(-)_Isosteric_A_C220S/PVA_/S267K/L368D/K370S (SEQ ID NOS 927-930)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVEMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 931)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP024016 human_IL15Ra(sushi)_(GGGGS)5-human_IL15(N1D/D61N;single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15(N1D/D61N;single-chain)_Fc(216)_IgG1_pI(-)_Isosteric_A_C220S/PVA_/S267K/L368D/K370S (SEQ ID NOS 932-935)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/DWVNVISDLKKIEDLIQSMHIDATLYTESDVHPSCKVTAMKCFLLELQVISLESGDAS
IHNTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 936)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 104AM

>XENP024017 human_IL15(D61N)-human_IL15Ra(Sushi)_Fc(216)_IgG1_pI(-
)_Isosteric_A_C220S/PVA_/S267K/L368D/K370S-Fc(216)_IgG1_C220S/PVA_/S267K/S364K/E357Q

Chain 1 - human_IL15(D61N)_Fc(216)_IgG1_pI(-)_Isosteric_A_C220S/PVA_/S267K/L368D/K370S (SEQ ID NOS 937-939)
NWVNVISDLKKIEDLIQSMHIDATLYTESDVHPSCKVTAMKCFLLELQVISLESGDASIHNTVENLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK

Chain 2 - human_IL15Ra(Sushi)_Fc(216)_IgG1_C220S/PVA_/S267K/S364K/E357Q (SEQ ID NOS 940-942)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP024018 human_IL15(N65D)-human_IL15Ra(Sushi)_Fc(216)_IgG1_pI(-
)_Isosteric_A_C220S/PVA_/S267K/L368D/K370S-Fc(216)_IgG1_C220S/PVA_/S267K/S364K/E357Q

Chain 1 - human_IL15(N65D)_Fc(216)_IgG1_pI(-)_Isosteric_A_C220S/PVA_/S267K/L368D/K370S (SEQ ID NOS 943-945)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK

Chain 2 - human_IL15Ra(Sushi)_Fc(216)_IgG1_C220S/PVA_/S267K/S364K/E357Q (SEQ ID NOS 946-948)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP024019 - human_IL15(Q108E)-human_IL15Ra(Sushi)_Fc(216)_IgG1_pI(-
)_Isosteric_A_C220S/PVA_/S267K/L368D/K370S-Fc(216)_IgG1_C220S/PVA_/S267K/S364K/E357Q

**Chain 1 - human_IL15(Q108E)-human_IL15Ra(Sushi)_Fc(216)_IgG1_pI(-
)_Isosteric_A_C220S/PVA_/S267K/L368D/K370S (19242) (SEQ ID NOS 949-951)**
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK

Chain 2 - human_IL15Ra(Sushi)_Fc(216)_IgG1_C220S/PVA_/S267K/S364K/E357Q (16481) (SEQ ID NOS 952-954)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 104AN

>XENP024020 - human_IL15(N1D/D61N)-human_IL15Ra(Sushi)_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15(N1D/D61N)_Fc(216)_IgG1_pI(-)_Isosteric_A_C220S/PVA_/S267K/L368D/K370S (19243) (SEQ ID NOS 955-957)
DWVNVISDLKKIEDLIQSMHIDATLYTESDVHPSCKVTAMKCFLLELQVISLESGDASIHNTVENLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 - human_IL15Ra(Sushi)_Fc(216)_IgG1_C220S/PVA_/S267K/S364K/E357Q (16481) (SEQ ID NOS 958-960)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP024043 human_IL15_E64Q/N65D_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_E64Q/N65D_(GGGGS)1_Fc(216)_IgG1_pI(-)_Isosteric_A_C220S/PVA_/S267K/L368D/K370S (SEQ ID NOS 961-963)
NWVNVISDLKKIEDLIQSMHIDATLYTESDVHPSCKVTAMKCFLLELQVISLESGDASIHDTVQDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (SEQ ID NOS 964-966)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP024044 human_IL15_N1D/N4D/N65D_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 – human_IL15_N1D/N4D/N65D_(GGGGS)1_Fc(216)_IgG1_pI(-)_Isosteric_A_C220S/PVA_/S267K/L368D/K370S (SEQ ID NOS 967-969)
DWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 – human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q (SEQ ID NOS 970-972)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 104AO

>XENP024045 human_IL15_D30N/E64Q/N65D_(GGGGS)1-
human_IL15Rα(Sushi)_(GGGGS)1_Fc(216)_IgG1_pI(-)_Isosteric_A_C220S/PVA_/S267K/L368D/K370S-
Fc(216)_IgG1_C220S/PVA_/S267K/S364K/E357Q Chain 1 – human_IL15_D30N/E64Q/N65D_(GGGGS)1_Fc(216)_IgG1_pI(-
)_Isosteric_A_C220S/PVA_/S267K/L368D/K370S (SEQ ID NOS 973-975)
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 – human_IL15Rα(Sushi)_(GGGGS)1_Fc(216)_IgG1_C220S/PVA_/S267K/S364K/E357Q (SEQ ID NOS
976-978)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP024048 human_IL15_N4D/D61N/N65D_(GGGGS)1-
human_IL15Rα(Sushi)_(GGGGS)1_Fc(216)_IgG1_pI(-)_Isosteric_A_C220S/PVA_/S267K/L368D/K370S-
Fc(216)_IgG1_C220S/PVA_/S267K/S364K/E357Q Chain 1 – human_IL15_N4D/D61N/N65D_(GGGGS)1_Fc(216)_IgG1_pI(-
)_Isosteric_A_C220S/PVA_/S267K/L368D/K370S (SEQ ID NOS 979-981)
NWVDVISDLKKIEDLIQSMHIDATLYTESDVHPSCKVTAMKCFLLELQVISLESGDASIHNTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 – human_IL15Rα(Sushi)_(GGGGS)1_Fc(216)_IgG1_C220S/PVA_/S267K/S364K/E357Q (SEQ ID NOS
982-984)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP024050 human_IL15Rα(sushi)_(GGGGS)5-human_IL15_N4D/N65D_(single-chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 – human_IL15Rα(sushi)_(GGGGS)5-human_IL15_N4D/N65D_(single-chain)_Fc(216)_IgG1_pI(-
)_Isosteric_A_C220S/PVA_/S267K/L368D/K370S (SEQ ID NOS 985-988)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Figure 104AO (continued)

Chain 2 – empty_ Fc(216)_IgG1_C220S/PVA_/S267K/S364K/E357Q (SEQ ID NO: 989)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 104AP

>XENP024051 human_IL15_N1D/N65D-human_IL15Rα(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15_N1D/N65D-human_Fc(216)_IgG1_pI(-
)_Isosteric_A_C220S/PVA_/S267K/L368D/K370S (SEQ ID NOS 990-992)
DWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWQEGDVFSCSVMHEALHNHYTQKSLSLSPGK Chain 2 – human_IL15Rα(Sushi)_ Fc(216)_IgG1_C220S/PVA_/S267K/S364K/E357Q (SEQ ID NOS 993-995)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP024052 human_IL15_N4D/N65D-human_IL15Rα(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15_N4D/N65D-human_ Fc(216)_IgG1_pI(-
)_Isosteric_A_C220S/PVA_/S267K/L368D/K370S (SEQ ID NOS 996-998)
NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWQEGDVFSCSVMHEALHNHYTQKSLSLSPGK Chain 2 – human_IL15Rα(Sushi)_Fc(216)_IgG1_C220S/PVA_/S267K/S364K/E357Q (SEQ ID NOS 999-1001)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP024113 human_IL15_N4D/N65D_(GGGGS)1-human_IL15Rα(Sushi)_(GGGGS)1_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S Chain 1 – human_IL15_N4D/N65D_(GGGGS)1_Fc(216)_IgG1_pI(-
)_Isosteric_A_C220S/PVA_/S267K/L368D/K370S/M428L/N434S (SEQ ID NOS 1002-1004)
NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWQEGDVFSCSVLHEALHSHYTQKSLSLSPGK Chain 2 –human_IL15Rα(Sushi)_(GGGGS)1_Fc(216)_IgG1_C220S/PVA_/S267K/S364K/E357Q/M428L/N434S
(SEQ ID NOS 1005-1007)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK

Figure 104AQ

>XENP024301 human_IL15_N4D/N65D-human_IL15Rα(Sushi)_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S Chain 1 – human_IL15_N4D/N65D_Fc(216)_IgG1_pI(-
)_Isosteric_A_C220S/PVA_/S267K/L368D/K370S/M428L/N434S (SEQ ID NOS 1008-1010)
NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVLHEALHSHYTQKSLSLSPGK Chain 2 – human_IL15Rα(Sushi)_Fc(216)_IgG1_C220S/PVA_/S267K/S364K/E357Q/M428L/N434S (SEQ ID NOS 1011-1013)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK >XENP024306 human_IL15_D30N/E64Q/N65D_(GGGGS)1-
human_IL15Rα(Sushi)_(GGGGS)1_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S Chain 1 – human_IL15_D30N/E64Q/N65D_(GGGGS)1_Fc(216)_IgG1_pI(-
)_Isosteric_A_C220S/PVA_/S267K/L368D/K370S/M428L/N434S (SEQ ID NOS 1014-1016)
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVLHEALHSHYTQKSLSLSPGK Chain 2 – human_IL15Rα(Sushi)_(GGGGS)1_Fc(216)_IgG1_C220S/PVA_/S267K/S364K/E357Q/M428L/N434S
(SEQ ID NOS 1017-1019)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK

Figure 104AR

>XENP024341 human_IL15_N1D/N65D-human_IL15Rα(Sushi)_Fc(216)_IgG1_pI(-)_Isosteric_A_C220S/PVA_/S267K/L368D/K370S/M428L/N434S-Fc(216)_IgG1_C220S/PVA_/S267K/S364K/E357Q/M428L/N434S Chain 1 – human_IL15_N1D/N65D-human_Fc(216)_IgG1_pI(-)_Isosteric_A_C220S/PVA_/S267K/L368D/K370S/M428L/N434S (SEQ ID NOS 1020-1022)
DWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVLHEALHSHYTQKSLSLSPGK Chain 2 – human_IL15Rα(Sushi)_Fc(216)_IgG1_C220S/PVA_/S267K/S364K/E357Q/M428L/N434S (SEQ ID NOS 1023-1025)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK >XENP024342 human_IL15(non-covalent; Q108E)-human_IL15Rα(Sushi)_Fc(216)_IgG1_C220S/PVA_/S267K Chain 1 – human_IL15Rα(Sushi)_Fc(216)_IgG1_C220S/PVA_/S267K (SEQ ID NOS 1026-1028)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK Chain 2 – human_IL15(non-covalent; Q108E) (SEQ ID NO: 1029)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS >XENP024346 human_IL15(non-covalent; Q108E)-human_IL15Rα(Sushi)_Fc(216)_IgG1_C220S/PVA_/S267K/M428L/N434S Chain 1 – human_IL15Rα(Sushi)_Fc(216)_IgG1_C220S/PVA_/S267K/M428L/N434S (SEQ ID NOS 1030-1032)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVLHEALHSHYTQKSLSLSPGK Chain 2 – human_IL15(non-covalent; Q108E) (SEQ ID NO: 1033)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS

Figure 104AS

>XENP024348_IL15(non-covalent)-human_IL15Ra(Sushi)_empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 – IL15 WT (SEQ ID NO: 1034)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Chain 2 – human_IL15Ra(Sushi)_Fc(216)_IgG1_pI(-)_Isosteric_A_C220S/PVA_/S267K/L368D/K370S (SEQ ID NOS 1035-1037)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 3 – empty_Fc(216)_IgG1_C220S/PVA_/S267K/S364K/E357Q (SEQ ID NO: 1038)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP024349_IL15_Q108E_(non-covalent)-human_IL15Ra(Sushi)_empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 – human_IL15Ra(Sushi)_Isosteric_A_C220S/PVA_/S267K/L368D/K370S (SEQ ID NOS 1039-1041)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 2 – empty-Fc(216)_IgG1_C220S/PVA_/S267K/S364K/E357Q (SEQ ID NO: 1042)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Chain 3 – IL15_Q108E_(non-covalent) (SEQ ID NO: 1043)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS >XENP024351_human_IL15(non-covalent; N4D/N65D)-human_IL15Ra(Sushi)_Fc(216)_IgG1_C220S/PVA_/S267K/M428L/N434S

Chain 1 – IL15(N4D/N65D) (SEQ ID NO: 1044)
NWVDVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

Chain 2 - human_IL15Ra(Sushi)_Fc(216)_IgG1_C220S/PVA_/S267K/M428L/N434S (SEQ ID NOS 1045-1047)
ITCPPPMSVEHADIWVKSYSLYSRERYICNSGFKRKAGTSSLTECVLNKATNVAHWTTPSLKCIR/EPKSSDKTHTCPPCPAPPVAGPSV
FLFPPKPKDTLMISRTPEVTCVVVDVKHEDPEVKFNWYVDGVEVHNAKTKPREEQYNSTYRVVSVLTVLHQDWLNGKEYKCKVSNKALPA
PIEKTISKAKGQPREPQVYTLPPSREEMTKNQVSLTCLVKGFYPSDIAVEWESNGQPENNYKTTPPVLDSDGSFFLYSKLTVDKSRWQQG
NVFSCSVLHEALHSHYTQKSLSLSPGK

Figure 104AT

>XENP024383 IL15_Q108E_(non-covalent)-human_IL15Ra(Sushi)_empty-Fc_Fc(216)_IgG1_pI(-)_Isosteric_A_C220S/PVA_/S267K/L368D/K370S/M428L/N434S-Fc(216)_IgG1_C220S/PVA_/S267K/S364K/E357Q/M428L/N434S Chain 1 - IL15_Q108E (SEQ ID NO: 1048)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS Chain 2 - human_IL15Ra(Sushi)_Fc(216)_IgG1_pI(-)_Isosteric_A_C220S/PVA_/S267K/L368D/K370S/M428L/N434S (SEQ ID NOS 1049-1051)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVLHEALHSHYTQKSLSLSPGK Chain 3 – empty_Fc(216)_IgG1_C220S/PVA_/S267K/S364K/E357Q/M428L/N434S (SEQ ID NO: 1052)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVLHEALHSHYTQKSL
SLSPGK >XENP024475 human_IL15Ra(sushi)_(GGGGS)6-human_IL15(single-chain;Q108E)-empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15Ra(sushi)_(GGGGS)6-human_IL15(single-chain;Q108E)_Fc(216)_IgG1_pI(-)_Isosteric_A_C220S/PVA_/S267K/L368D/K370S (SEQ ID NOS 1053-1056)
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGS/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVEMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 1057)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 104AU

>XENP024476 human_IL15Ra(sushi)_(GGGGS)6-human_IL15(single-chain;N4D/N65D)-empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15Ra(sushi)_(GGGGS)6-human_IL15(single-chain;N4D/N65D)_Fc(216)_IgG1_pI(-)_Isosteric_A_C220S/PVA_/S267K/L368D/K370S (SEQ ID NOS 1058-1061)
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGS/NWVDVISDLKKIEDLIQSMHIDATLYTESDVHPSCKVTAMKCFLLELQVISLE
SGDASIHDTVEDLIILANNSLSSNGNVTESGCKECEELEEKNIKEFLQSFVHIVQMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 1062)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP024477 human_IL15Ra(sushi)_(GGGGS)7-human_IL15(single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15Ra(sushi)_(GGGGS)7-human_IL15(single-chain)_Fc(216)_IgG1_pI(-)_Isosteric_A_C220S/PVA_/S267K/L368D/K370S (SEQ ID NOS 1063-1066)
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGS/NWVNVISDLKKIEDLIQSMHIDATLYTESDVHPSCKVTAMKCFLLELQ
VISLESGDASIHDTVENLIILANNSLSSNGNVTESGCKECEELEEKNIKEFLQSFVHIVQMFINTS/EPKSSDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 1067)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP024478 human_IL15Ra(sushi)_(GGGGS)7-human_IL15(single-chain;Q108E)-empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15Ra(sushi)_(GGGGS)7-human_IL15(single-chain;Q108E)_Fc(216)_IgG1_pI(-)_Isosteric_A_C220S/PVA_/S267K/L368D/K370S (SEQ ID NOS 1068-1071)
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGS/NWVNVISDLKKIEDLIQSMHIDATLYTESDVHPSCKVTAMKCFLLELQ
VISLESGDASIHDTVENLIILANNSLSSNGNVTESGCKECEELEEKNIKEFLQSFVHIVEMFINTS/EPKSSDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 1072)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 104AV

>XENP024479 human_IL15Ra(sushi)_(GGGGS)7-human_IL15(single-chain;N4D/N65D)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)7-human_IL15(single-chain;N4D/N65D)_Fc(216)_IgG1_pI(-
)_Isosteric_A_C220S/PVA_/S267K/L368D/K370S (SEQ ID NOS 1073-1076)
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGSGGGGS/NWVDVISDLKKIEDLIQSMHIDATLYTESDVHPSCKVTAMKCFLLELQ
VISLESGDASIHDTVEDLIILANNSLSSNGNVTESGCKECEELEEKNIKEFLQSFVHIVQMFINTS/EPKSSDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK Chain 2 - empty-Fc_Fc(216)_IgG1_C220S/PVA_/S267K/S364K/E357Q (SEQ ID NO: 1077)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP024480 human_IL15Ra(sushi)_(30AA_linker_variant)-human_IL15(single-chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(30AA_linker_variant)-human_IL15(single-chain)_Fc(216)_IgG1_pI(-
)_Isosteric_A_C220S/PVA_/S267K/L368D/K370S (SEQ ID NOS 1078-1081)
ITCPPPMSVEHADIWVKSYSLYSRERYICNSGFKRKAGTSSLTECVLNKATNVAHWTTPSLKCIR/DPALVHQRP
APPGGGGSGGGGSGGGGSGGG/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVQMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 1082)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 104AW

>XENP024481 human_IL15Ra(sushi)_(30AA_linker_variant)-human_IL15(single-chain;Q108E)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(30AA_linker_variant)-human_IL15(single-chain;Q108E)_Fc(216)_IgG1_pI(-
)_Isosteric_A_C220S/PVA_/S267K/L368D/K370S (SEQ ID NOS 1083-1086)
ITCPPPMSVEHADIWVKSYSLYSRERYICNSGFKRKAGTSSLTECVLNKATNVAHWTTPSLKCIR/DPALVHQRP
APPGGGGSGGGGSGGGGSGGG/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVEMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 1087)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP024890 IL15_N4D/N65D_(non-covalent)-human_IL15Ra(Sushi)-empty-Fc_IgG1_Fc(216)_IgG1_pI(-
)_Isosteric_A_C220S/PVA_/S267K/L368D/K370S-IgG1_PVA_/S267K/S364K/E357Q Chain 1 – IL-15_N4D/N65D (SEQ ID NOS 1088-1090)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK Chain 2 - human_IL15Ra(Sushi)_Fc(216)_IgG1_pI(-)_Isosteric_A_C220S/PVA_/S267K/L368D/K370S (SEQ ID
NOS 1091-1093)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK Chain 3 – empty_Fc(216)_IgG1_PVA_/S267K/S364K/E357Q (SEQ ID NO: 1094)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 104AX

>XENP25138 IL15_D30N/E64Q/N65D_(non-covalent)-empty-Fc_Fc(216)_IgG1_pI(-
)_Isosteric_A_C220S/PVA_/S267K/L368D/K370S-IgG1_PVA_/S267K/S364K/E357Q Chain 1 - IL15_D30N/E64Q/N65D (SEQ ID NO: 1095)
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS Chain 2 - human_IL15Ra(Sushi)_Fc(216)_IgG1_pI(-)_Isosteric_A_C220S/PVA_/S267K/L368D/K370S (SEQ ID NOS 1096-1098)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK Chain 3 - empty_Fc(216)_IgG1_PVA_/S267K/S364K/E357Q (SEQ ID NO: 1099)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP025938 human_IL15Ra(sushi)_(GGGGS)5-human_IL15_N4D/N65D_(single-chain)-empty-
Fc_Fc(216)_IgG1_pI(-)_Isosteric_A_C220S/PVA_/S267K/L368D/K370S/M428L/N434S-
Fc(216)_IgG1_C220S/PVA_/S267K/S364K/E357Q/M428L/N434S Chain 1 – human_IL15Ra(sushi)_(GGGGS)5-human_IL15_N4D/N65D_(single-chain)-_Fc(216)_IgG1_pI(-
)_Isosteric_A_C220S/PVA_/S267K/L368D/K370S/M428L/N434S (SEQ ID NOS 1100-1103)
ITCPPPMSVEHADIWVKSYSLYSRERYICNSGFKRKAGTSSLTECVLNKATNVAHWTTPSLKCIR/GGGGSGGGGSGGGGSGGGGSGGGG
S/NWVDVISDLKKIEDLIQSMHIDATLYTESDVHPSCKVTAMKCFLLELQVISLESGDASIHDTVEDLIILANNSLSSNGNVTESGCKEC
EELEEKNIKEFLQSFVHIVQMFINTS/EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQPREPQVYTLPPSREEMTKNQVSLTCDV
SGFYPSDIAVEWESDGQPENNYKTTPPVLDSDGSFFLYSKLTVDKSRWEQGDVFSCSVLHEALHSHYTQKSLSLSPGK Chain 2 – empty_Fc(216)_IgG1_C220S/PVA_/S267K/S364K/E357Q/M428L/N434S (SEQ ID NOS 1104-1108)
EPKSSDKTHTCPPCPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWESNGQPENNYKTTPP
VLDSDGSFFLYSKLTVDKSRWQQGNVFSCSVLHEALHSHYTQKSLSLSPGK human_IL15Ra(sushi)(single-chain)-human_IL15_Fc(216)_IgG1_C220S/PVA_/S267K; corresponding to Figure
14

ITCPPPMSVEHADIWVKSYSLYSRERYICNSGFKRKAGTSSLTECVLNKATNVAHWTTPSLKCIR/GGGGS/NWV
NVISDLKKIEDLIQSMHIDATLYTESDVHPSCKVTAMKCFLLELQVISLESGDASIHDTVENLIILANNSLSSNG
NVTESGCKECEELEEKNIKEFLQSFVHIVQMFINTS/EPKSSDKTHTCPPCPAPPVAGPSVFLFPPKPKDTLMIS
RTPEVTCVVVDVKHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK

Figure 104AY empty-Fc(216)_IgG1_pI(-
)_Isosteric_A_C220S/PVA_/S267K/L368D/K370S_(GGGGS)2_IL15Ra(Sushi)_IL15(single-
chain)_IgG1_ISO(+RR)_C220S/PVA_/S267K/S364K/E357Q; corresponding to Figure 16

Chain 1 - empty-Fc(216)_IgG1_pI(-
)_Isosteric_A_C220S/PVA_/S267K/L368D/K370S_(GGGGS)2_IL15Ra(Sushi)_IL15(single-chain) (SEQ ID NOS 1109-1112)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIR/GGGGS/NWVNVISDLKKIEDLIQSMHIDATLYTESDVHPSCKVTAMKCFLLELQVISLESGDASIH
DTVENLIILANNSLSSNGNVTESGCKECEELEEKNIKEFLQSFVHIVQMFINTS Chain 2 - empty-Fc(216)_IgG1_ISO(+RR)_C220S/PVA_/S267K/S364K/E357Q (8927) (SEQ ID NO: 1113)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 104AZ

IL-15 and IL-15 receptor Sequences - corresponds to Figure 2

Human IL-15 precursor sequence (SEQ ID NO: 1114)

>sp|P40933
MRISKPHLRSISIQCYLCLLLNSHFLTEAGIHVFILGCFSAGLPKTEANWVNVISDLKKIEDLIQSMHIDATLYT
ESDVHPSCKVTAMKCFLLELQVISLESGDASIHDTVENLIILANNSLSSNGNVTESGCKECEELEEKNIKEFLQS
FVHIVQMFINTS

Human IL-15 mature form sequence (SEQ ID NO: 1115)

>sp|P40933|49-162
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Human IL-15Rα sequence (SEQ ID NO: 1116)

>sp|Q13261
MAPRRARGCRTLGLPALLLLLLLRPPATRGITCPPPMSVEHADIWVKSYSLYSRERYICNSGFKRKAGTSSLTEC
VLNKATNVAHWTTPSLKCIRDPALVHQRPAPPSTVTTAGVTPQPESLPSGKEPAASSPSSNNTAATTAAIVPGS
QLMPSKSPSTGTTEISSHESSHGTPSQTTAKNWELTASASHQPPGVYPQGHSDTTVAISTSTVLLCGLSAVSLLA
CYLKSRQTPPLASVEMEAMEALPVTWGTSSRDEDLENCSHHL

Human IL-15Rα, extracellular domain (SEQ ID NO: 1117)

>sp|Q13261|31-205
ITCPPPMSVEHADIWVKSYSLYSRERYICNSGFKRKAGTSSLTECVLNKATNVAHWTTPSLKCIRDPALVHQRPA
PPSTVTTAGVTPQPESLPSGKEPAASSPSSNNTAATTAAIVPGSQLMPSKSPSTGTTEISSHESSHGTPSQTTA
KNWELTASASHQPPGVYPQGHSDTT

Human IL-15Rα, sushi domain (SEQ ID NO: 1118)

>sp|Q13261|31-95
ITCPPPMSVEHADIWVKSYSLYSRERYICNSGFKRKAGTSSLTECVLNKATNVAHWTTPSLKCIR

Human IL-15Rβ sequence (SEQ ID NO: 1119)

>sp|P14784
MAAPALSWRLPLLILLLPLATSWASAAVNGTSQFTCFYNSRANISCVWSQDGALQDTSCQVHAWPDRRRWNQTCE
LLPVSQASWACNLILGAPDSQKLTTVDIVTLRVLCREGVRWRVMAIQDFKPFENLRLMAPISLQVVHVETHRCNI
SWEISQASHYFERHLEFEARTLSPGHTWEEAPLLTLKQKQEWICLETLTPDTQYEFQVRVKPLQGEFTTWSPWSQ
PLAFRTKPAALGKDTIPWLGHLLVGLSGAFGFIILVYLLINCRNTGPWLKKVLKCNTPDPSKFFSQLSSEHGGDV
QKWLSSPFPSSSFSPGGLAPEISPLEVLERDKVTQLLLQQDKVPEPASLSSNHSLTSCFTNQGYFFFHLPDALEI
EACQVYFTYDPYSEEDPDEGVAGAPTGSSPQPLQPLSGEDDAYCTFPSRDDLLLFSPSLLGGPSPPSTAPGGSGA
GEERMPPSLQERVPRDWDPQPLGPPTPGVPDLVDFQPPPELVLREAGEEVPDAGPREGVSFPWSRPPGQGEFRAL
NARLPLNTDAYLSLQELQGQDPTHLV

Human IL-15Rβ, extracellular domain (SEQ ID NO: 1120)

>sp|P14784|27-240
AVNGTSQFTCFYNSRANISCVWSQDGALQDTSCQVHAWPDRRRWNQTCELLPVSQASWACNLILGAPDSQKLTTV
DIVTLRVLCREGVRWRVMAIQDFKPFENLRLMAPISLQVVHVETHRCNISWEISQASHYFERHLEFEARTLSPGH
TWEEAPLLTLKQKQEWICLETLTPDTQYEFQVRVKPLQGEFTTWSPWSQPLAFRTKPAALGKDT

Figure 104BA

Human common gamma chain sequence (SEQ ID NO: 1121)

>sp|P31785

MLKPSLPFTSLLFLQLPLLGVGLNTTILTPNGNEDTTADFFLTTMPTDSLSVSTLPLPEVQCFVFNVEYMNCTWN
SSSEPQPTNLTLHYWYKNSDNDKVQKCSHYLFSEEITSGCQLQKKEIHLYQTFVVQLQDPREPRRQATQMLKLQN
LVIPWAPENLTLHKLSESQLELNWNNRFLNHCLEHLVQYRTDWDHSWTEQSVDYRHKFSLPSVDGQKRYTFRVRS
RFNPLCGSAQHWSEWSHPIHWGSNTSKENPFLFALEAVVISVGSMGLIISLLCVYFWLERTMPRIPTLKNLEDLV
TEYHGNFSAWSGVSKGLAESLQPDYSERLCLVSEIPPKGGALGEGPGASPCNQHSPYWAPPCYTLKPET

Human common gamma chain, extracellular domain (SEQ ID NO: 1122)

>sp|P31785|23-262

LNTTILTPNGNEDTTADFFLTTMPTDSLSVSTLPLPEVQCFVFNVEYMNCTWNSSSEPQPTNLTLHYWYKNSDND
KVQKCSHYLFSEEITSGCQLQKKEIHLYQTFVVQLQDPREPRRQATQMLKLQNLVIPWAPENLTLHKLSESQLEL
NWNNRFLNHCLEHLVQYRTDWDHSWTEQSVDYRHKFSLPSVDGQKRYTFRVRSRFNPLCGSAQHWSEWSHPIHWG
SNTSKENPFLFALEA

Figure 104BB

Linker Sequences - corresponds to Figure 7

|  | SEQ ID NO |
|---|---|
| GGGGS | 14 |
| GGGGSGGGGS | 15 |
| GGGGSGGGGSGGGGS | 16 |
| GGGGSGGGGSGGGGSGGGGS | 17 |
| GGGGSGGGGSGGGGSGGGGSGGGGS | 18 |
| GGGGSGGGGSGGGGSGGGGSGGGGSGGGGS | 19 |
| GGGGSGGGGSGGGGSGGGGSGGGGSGGGGSGGGGS | 20 |
| DPALVHQRPAPPGGGGSGGGGSGGGGSGGG | 21 |
| GKPGS | 22 |
| GKPGSGKPGSGKPGSGKPGSGKPGS | 23 |
| GKPGSGKPGSGKPGSGKPGSGKPGSGKPGS | 24 |
| GGGES | 25 |

Figure 104BC

Backbone Sequences - corresponds to Figure 9

IL-15/Rα-Fc Backbone 1

\>IL-15/Rα-Fc monomer 1 (SEQ ID NO: 1123)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK \>IL-15/Rα-Fc monomer 2 (SEQ ID NO: 1124)
EPKSSDKTHTCPPCPAPPVAGPSVFLFPPKPKDTLMISRTPEVTCVVVDVKHEDPEVKFNWYVDGVEV
HNAKTKPREEEYNSTYRVVSVLTVLHQDWLNGKEYKCKVSNKALPAPIEKTISKAKGQPREPQVYTLP
PSREEMTKNQVSLTCDVSGFYPSDIAVEWESDGQPENNYKTTPPVLDSDGSFFLYSKLTVDKSRWEQG
DVFSCSVMHEALHNHYTQKSLSLSPGK

IL-15/Rα-Fc Backbone 2

\>IL-15/Rα-Fc monomer 1 (SEQ ID NO: 1125)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREEMTKNQVKLTCLVKGFYPSDIAVEWESNGQPENNYKTTPPVLDSDGSFFLYSKLTVDKSRWQQG
NVFSCSVMHEALHNHYTQKSLSLSPGK \>IL-15/Rα-Fc monomer 2 (SEQ ID NO: 1126)
EPKSSDKTHTCPPCPAPPVAGPSVFLFPPKPKDTLMISRTPEVTCVVVDVKHEDPEVKFNWYVDGVEV
HNAKTKPREEEYNSTYRVVSVLTVLHQDWLNGKEYKCKVSNKALPAPIEKTISKAKGQPREPQVYTLP
PSREEMTKNQVSLTCDVSGFYPSDIAVEWESDGQPENNYKTTPPVLDSDGSFFLYSKLTVDKSRWEQG
DVFSCSVMHEALHNHYTQKSLSLSPGK

IL-15/Rα-Fc Backbone 3

\>IL-15/Rα-Fc monomer 1 (SEQ ID NO: 1127)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREEMTKNQVKLTCLVKGFYPSDIAVEWESNGQPENNYKTTPPVLDSDGSFFLYSKLTVDKSRWQQG
NVFSCSVMHEALHNHYTQKSLSLSPGK \>IL-15/Rα-Fc monomer 2 (SEQ ID NO: 1128)
EPKSSDKTHTCPPCPAPPVAGPSVFLFPPKPKDTLMISRTPEVTCVVVDVKHEDPEVKFNWYVDGVEV
HNAKTKPREEEYNSTYRVVSVLTVLHQDWLNGKEYKCKVSNKALPAPIEKTISKAKGQPREPQVYTLP
PSREEMTKNQVSLTCEVSGFYPSDIAVEWESDGQPENNYKTTPPVLDSDGSFFLYSKLTVDKSRWEQG
DVFSCSVMHEALHNHYTQKSLSLSPGK

Figure 104BD

IL-15/Rα-Fc Backbone 4
>IL-15/Rα-Fc monomer 1 (SEQ ID NO: 1129)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSKGSFFLYSKLTVDKSRWQQG
NVFSCSVMHEALHNHYTQKSLSLSPGK

>IL-15/Rα-Fc monomer 2 (SEQ ID NO: 1130)
EPKSSDKTHTCPPCPAPPVAGPSVFLFPPKPKDTLMISRTPEVTCVVVDVKHEDPEVKFNWYVDGVEV
HNAKTKPREEEYNSTYRVVSVLTVLHQDWLNGKEYKCKVSNKALPAPIEKTISKAKGQPREPQVYTLP
PSREEMTENEVSLTCLVKGFYPSDIAVEWESDGQPENNYKTTPPVLDSDGSFFLYSKLEVDKSRWEQG
DVFSCSVMHEALHNHYTQKSLSLSPGK

IL-15/Rα-Fc Backbone 5
>IL-15/Rα-Fc monomer 1 (SEQ ID NO: 1131)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSRDQLTKNQVKLTCLVKGFYPSDIAVEWESNGQPENNYKTTPPVLDSDGSFFLYSKLTVDKSRWQQG
NVFSCSVMHEALHNHYTQKSLSLSPGK

>IL-15/Rα-Fc monomer 2 (SEQ ID NO: 1132)
EPKSSDKTHTCPPCPAPPVAGPSVFLFPPKPKDTLMISRTPEVTCVVVDVKHEDPEVKFNWYVDGVEV
HNAKTKPREEEYNSTYRVVSVLTVLHQDWLNGKEYKCKVSNKALPAPIEKTISKAKGQPREPQVYTLP
PSRDELTKNQVSLTCDVSGFYPSDIAVEWESDGQPENNYKTTPPVLDSDGSFFLYSKLTVDKSRWEQG
DVFSCSVMHEALHNHYTQKSLSLSPGK

IL-15/Rα-Fc Backbone 6
>IL-15/Rα-Fc monomer 1 (SEQ ID NO: 1133)
EPKSSDKTHTCPPCPAPPVAGPSVFLFPPKPKDTLMISRTPEVTCVVVDVKHEDPEVKFNWYVDGVEV
HNAKTKPREEQYASTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK

>IL-15/Rα-Fc monomer 2 (SEQ ID NO: 1134)
EPKSSDKTHTCPPCPAPPVAGPSVFLFPPKPKDTLMISRTPEVTCVVVDVKHEDPEVKFNWYVDGVEV
HNAKTKPREEEYASTYRVVSVLTVLHQDWLNGKEYKCKVSNKALPAPIEKTISKAKGQPREPQVYTLP
PSREEMTKNQVSLTCDVSGFYPSDIAVEWESDGQPENNYKTTPPVLDSDGSFFLYSKLTVDKSRWEQG
DVFSCSVMHEALHNHYTQKSLSLSPGK

Figure 104BE

IL-15/Rα-Fc Backbone 7
>IL-15/Rα-Fc monomer 1 (SEQ ID NO: 1135)
EPKSSDKTHTCPPCPAPPVAGPSVFLFPPKPKDTLMISRTPEVTCVVVDVKHEDPEVKFNWYVDGVEV
HNAKTKPREEQYSSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK

>IL-15/Rα-Fc monomer 2 (SEQ ID NO: 1136)
EPKSSDKTHTCPPCPAPPVAGPSVFLFPPKPKDTLMISRTPEVTCVVVDVKHEDPEVKFNWYVDGVEV
HNAKTKPREEEYSSTYRVVSVLTVLHQDWLNGKEYKCKVSNKALPAPIEKTISKAKGQPREPQVYTLP
PSREEMTKNQVSLTCDVSGFYPSDIAVEWESDGQPENNYKTTPPVLDSDGSFFLYSKLTVDKSRWEQG
DVFSCSVMHEALHNHYTQKSLSLSPGK

IL-15/Rα-Fc Backbone 8
>IL-15/Rα-Fc monomer 1 (SEQ ID NO: 1137)
ESKYGPPCPPCPAPEFLGGPSVFLFPPKPKDTLMISRTPEVTCVVVDVSQEDPEVQFNWYVDGVEVHN
AKTKPREEQFNSTYRVVSVLTVLHQDWLNGKEYKCKVSNKGLPSSIEKTISKAKGQPREPQVYTLPPS
QEQMTKNQVKLTCLVKGFYPSDIAVEWESNGQPENNYKTTPPVLDSDGSFFLYSRLTVDKSRWQEGNV
FSCSVMHEALHNHYTQKSLSLSLGK

>IL-15/Rα-Fc monomer 2 (SEQ ID NO: 1138)
ESKYGPPCPPCPAPEFLGGPSVFLFPPKPKDTLMISRTPEVTCVVVDVSQEDPEVQFNWYVDGVEVHN
AKTKPREEEFNSTYRVVSVLTVLHQDWLNGKEYKCKVSNKGLPSSIEKTISKAKGQPREPQVYTLPPS
QEEMTKNQVSLTCDVSGFYPSDIAVEWESDGQPENNYKTTPPVLDSDGSFFLYSRLTVDKSRWEEGDV
FSCSVMHEALHNHYTQKSLSLSLGK

IL-15/Rα-Fc Backbone 9
>IL-15/Rα-Fc monomer 1 (SEQ ID NO: 1139)
ERKCCVECPPCPAPPVAGPSVFLFPPKPKDTLMISRTPEVTCVVVDVSHEDPEVQFNWYVDGVEVHNA
KTKPREEQFNSTFRVVSVLTVVHQDWLNGKEYKCKVSNKGLPAPIEKTISKTKGQPREPQVYTLPPSR
EQMTKNQVKLTCLVKGFYPSDIAVEWESNGQPENNYKTTPPMLDSDGSFFLYSKLTVDKSRWQQGNVF
SCSVMHEALHNHYTQKSLSLSPGK

>IL-15/Rα-Fc monomer 2 (SEQ ID NO: 1140)
ERKCCVECPPCPAPPVAGPSVFLFPPKPKDTLMISRTPEVTCVVVDVSHEDPEVQFNWYVDGVEVHNA
KTKPREEEFNSTFRVVSVLTVVHQDWLNGKEYKCKVSNKGLPAPIEKTISKTKGQPREPQVYTLPPSR
EEMTKNQVSLTCDVSGFYPSDIAVEWESDGQPENNYKTTPPMLDSDGSFFLYSKLTVDKSRWEQGDVF
SCSVMHEALHNHYTQKSLSLSPGK

Figure 104BF

IL-15/Rα-Fc Backbone 10
>IL-15/Rα-Fc monomer 1 (SEQ ID NO: 1141)
ERKCCVECPPCPAPPVAGPSVFLFPPKPKDTLMISRTPEVTCVVVDVKHEDPEVQFNWYVDGVEVHNA
KTKPREEQFNSTFRVVSVLTVVHQDWLNGKEYKCKVSNKGLPAPIEKTISKTKGQPREPQVYTLPPSR
EQMTKNQVKLTCLVKGFYPSDIAVEWESNGQPENNYKTTPPMLDSDGSFFLYSKLTVDKSRWQQGNVF
SCSVMHEALHNHYTQKSLSLSPGK >IL-15/Rα-Fc monomer 2 (SEQ ID NO: 1142)
ERKCCVECPPCPAPPVAGPSVFLFPPKPKDTLMISRTPEVTCVVVDVKHEDPEVQFNWYVDGVEVHNA
KTKPREEEFNSTFRVVSVLTVVHQDWLNGKEYKCKVSNKGLPAPIEKTISKTKGQPREPQVYTLPPSR
EEMTKNQVSLTCDVSGFYPSDIAVEWESDGQPENNYKTTPPMLDSDGSFFLYSKLTVDKSRWEQGDVF
SCSVMHEALHNHYTQKSLSLSPGK IL-15/Rα-Fc Backbone 11
>IL-15/Rα-Fc monomer 1 (SEQ ID NO: 1143)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVLHEALHSHYTQKSLSLSPGK >IL-15/Rα-Fc monomer 2 (SEQ ID NO: 1144)
EPKSSDKTHTCPPCPAPPVAGPSVFLFPPKPKDTLMISRTPEVTCVVVDVKHEDPEVKFNWYVDGVEV
HNAKTKPREEEYNSTYRVVSVLTVLHQDWLNGKEYKCKVSNKALPAPIEKTISKAKGQPREPQVYTLP
PSREEMTKNQVSLTCDVSGFYPSDIAVEWESDGQPENNYKTTPPVLDSDGSFFLYSKLTVDKSRWEQG
DVFSCSVLHEALHSHYTQKSLSLSPGK IL-15/Rα-Fc Backbone 12
>IL-15/Rα-Fc monomer 1 (SEQ ID NO: 1145)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSDGSFFLYSKLTVDKSRWQQG
NVFSCSVMHEALHNHYTQKSLSLSPGK >IL-15/Rα-Fc monomer 2 (SEQ ID NO: 1146)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSDGSFFLYSKLTVDKSRWQQG
NVFSCSVMHEALHNHYTQKSLSLSPGK

Figure 104BG

IL-15/Rα-Fc Backbone 13

\>IL-15/Rα-Fc monomer 1 (SEQ ID NO: 1147)
EPKSSDKTHTCPPCPAPPVAGPSVFLFPPKPKDTLMISRTPEVTCVVVDKHEDPEVKFNWYVDGVEV
HNAKTKPREEEYNSTYRVVSVLTVLHQDWLNGKEYKCKVSNKALPAPIEKTISKAKGQPREPQVYTLP
PSREEMTKNQVSLTCDVSGFYPSDIAVEWESDGQPENNYKTTPPVLDSDGSFFLYSKLTVDKSRWEQG
DVFSCSVMHEALHNHYTQKSLSLSPGK \>IL-15/Rα-Fc monomer 2 (SEQ ID NO: 1148)
ERKSSDKTHTCPRCPAPPVAGPSVFLFPPKPKDTLMISRTPEVTCVVVDVKHEDPEVKFKWYVDGVEV
HNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK

Figure 104BH

Example 2A sequences

IL-15Rα(sushi-D96) of Figure 27 (SEQ ID NO: 1149)
ITCPPPMSVEHADIWVKSYSLYSRERYICNSGFKRKAGTSSLTECVLNKATNVAHWTTPSLKCIRD

IL-15Rα(sushi-D96/P97) of Figure 27 (SEQ ID NO: 1150)
ITCPPPMSVEHADIWVKSYSLYSRERYICNSGFKRKAGTSSLTECVLNKATNVAHWTTPSLKCIRDP

IL-15Rα(sushi-D96/P97/A98) of Figure 27 (SEQ ID NO: 1151)
ITCPPPMSVEHADIWVKSYSLYSRERYICNSGFKRKAGTSSLTECVLNKATNVAHWTTPSLKCIRDPA

IL-15(E87C) of Figure 28 (SEQ ID NO: 1152)
NWVNVISDLKKIEDLIQSMHIDATLYTESDVHPSCKVTAMKCFLLELQVISLESGDASIHDTVENLII
LANNSLSSNGNVTESGCKCCEELEEKNIKEFLQSFVHIVQMFINTS

IL-15(V49C) of Figure 28 (SEQ ID NO: 1153)
NWVNVISDLKKIEDLIQSMHIDATLYTESDVHPSCKVTAMKCFLLELQCISLESGDASIHDTVENLII
LANNSLSSNGNVTESGCKECEELEEKNIKEFLQSFVHIVQMFINTS

IL-15(L52C) of Figure 28 (SEQ ID NO: 1154)
NWVNVISDLKKIEDLIQSMHIDATLYTESDVHPSCKVTAMKCFLLELQVISCESGDASIHDTVENLII
LANNSLSSNGNVTESGCKECEELEEKNIKEFLQSFVHIVQMFINTS

IL-15(E89C) of Figure 28 (SEQ ID NO: 1155)
NWVNVISDLKKIEDLIQSMHIDATLYTESDVHPSCKVTAMKCFLLELQVISLESGDASIHDTVENLII
LANNSLSSNGNVTESGCKECCELEEKNIKEFLQSFVHIVQMFINTS

IL-15(Q48C) of Figure 28 (SEQ ID NO: 1156)
NWVNVISDLKKIEDLIQSMHIDATLYTESDVHPSCKVTAMKCFLLELCVISLESGDASIHDTVENLII
LANNSLSSNGNVTESGCKECEELEEKNIKEFLQSFVHIVQMFINTS

IL-15(E53C) of Figure 28 (SEQ ID NO: 1157)
NWVNVISDLKKIEDLIQSMHIDATLYTESDVHPSCKVTAMKCFLLELQVISLCSGDASIHDTVENLII
LANNSLSSNGNVTESGCKECEELEEKNIKEFLQSFVHIVQMFINTS
of Figure 28
IL-15(C42S) (SEQ ID NO: 1158)
NWVNVISDLKKIEDLIQSMHIDATLYTESDVHPSCKVTAMKSFLLELQVISLESGDASIHDTVENLII
LANNSLSSNGNVTESGCKECEELEEKNIKEFLQSFVHIVQMFINTS

IL-15(L45C) of Figure 28 (SEQ ID NO: 1159)
NWVNVISDLKKIEDLIQSMHIDATLYTESDVHPSCKVTAMKCFLCELQVISLESGDASIHDTVENLII
LANNSLSSNGNVTESGCKECEELEEKNIKEFLQSFVHIVQMFINTS

Figure 104BI

IL-15Rα(sushi-D96/C97) of Figure 29 (SEQ ID NO: 1160)
ITCPPPMSVEHADIWVKSYSLYSRERYICNSGFKRKAGTSSLTECVLNKATNVAHWTTPSLKCIRDC IL-15Rα(sushi-D96/P97/C98) of Figure 29 (SEQ ID NO: 1161)
ITCPPPMSVEHADIWVKSYSLYSRERYICNSGFKRKAGTSSLTECVLNKATNVAHWTTPSLKCIRDPC IL-15Rα(sushi-D96/C97/A98) of Figure 29 (SEQ ID NO: 1162)
ITCPPPMSVEHADIWVKSYSLYSRERYICNSGFKRKAGTSSLTECVLNKATNVAHWTTPSLKCIRDCA IL-15Rα(sushi-S40C) of Figure 29 (SEQ ID NO: 1163)
ITCPPPMSVEHADIWVKSYSLYSRERYICNSGFKRKAGTCSLTECVLNKATNVAHWTTPSLKCIR IL-15Rα(sushi-K34C) of Figure 29 (SEQ ID NO: 1164)
ITCPPPMSVEHADIWVKSYSLYSRERYICNSGFCRKAGTSSLTECVLNKATNVAHWTTPSLKCIR IL-15Rα(sushi-G38C) of Figure 29 (SEQ ID NO: 1165)
ITCPPPMSVEHADIWVKSYSLYSRERYICNSGFKRKACTSSLTECVLNKATNVAHWTTPSLKCIR IL-15Rα(sushi-L42C) of Figure 29 (SEQ ID NO: 1166)
ITCPPPMSVEHADIWVKSYSLYSRERYICNSGFKRKAGTSSCTECVLNKATNVAHWTTPSLKCIR IL-15Rα(sushi-A37C) of Figure 29 (SEQ ID NO: 1167)
ITCPPPMSVEHADIWVKSYSLYSRERYICNSGFKRKCGTSSLTECVLNKATNVAHWTTPSLKCIR

Figure 104BJ

IL-15 Variant Sequences – corresponds to Figure 47

N1D (SEQ ID NO: 1168)
DWVNVISDLKKIEDLIQSMHIDATLYTESDVHPSCKVTAMKCFLLELQVISLESGDASIHDTVENLIILANNSLSSNGNV
TESGCKECEELEEKNIKEFLQSFVHIVQMFINTS

N4D (SEQ ID NO: 1169)
NWVDVISDLKKIEDLIQSMHIDATLYTESDVHPSCKVTAMKCFLLELQVISLESGDASIHDTVENLIILANNSLSSNGNV
TESGCKECEELEEKNIKEFLQSFVHIVQMFINTS

D8N (SEQ ID NO: 1170)
NWVNVISNLKKIEDLIQSMHIDATLYTESDVHPSCKVTAMKCFLLELQVISLESGDASIHDTVENLIILANNSLSSNGNV
TESGCKECEELEEKNIKEFLQSFVHIVQMFINTS

D30N (SEQ ID NO: 1171)
NWVNVISDLKKIEDLIQSMHIDATLYTESNVHPSCKVTAMKCFLLELQVISLESGDASIHDTVENLIILANNSLSSNGNV
TESGCKECEELEEKNIKEFLQSFVHIVQMFINTS

D61N (SEQ ID NO: 1172)
NWVNVISDLKKIEDLIQSMHIDATLYTESDVHPSCKVTAMKCFLLELQVISLESGDASIHNTVENLIILANNSLSSNGNV
TESGCKECEELEEKNIKEFLQSFVHIVQMFINTS

E64Q (SEQ ID NO: 1173)
NWVNVISDLKKIEDLIQSMHIDATLYTESDVHPSCKVTAMKCFLLELQVISLESGDASIHDTVQNLIILANNSLSSNGNV
TESGCKECEELEEKNIKEFLQSFVHIVQMFINTS

N65D (SEQ ID NO: 1174)
NWVNVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS

Q108E (SEQ ID NO: 1175)
NWVNVISDLKKIEDLIQSMHIDATLYTESDVHPSCKVTAMKCFLLELQVISLESGDASIHDTVENLIILANNSLSSNGNV
TESGCKECEELEEKNIKEFLQSFVHIVEMFINTS

N1D/D61N (SEQ ID NO: 1176)
DWVNVISDLKKIEDLIQSMHIDATLYTESDVHPSCKVTAMKCFLLELQVISLESGDASIHNTVENLIILANNSLSSNGNV
TESGCKECEELEEKNIKEFLQSFVHIVQMFINTS

Figure 104BK

N1D/E64Q (SEQ ID NO: 1177)
DWVNVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

N4D/D61N (SEQ ID NO: 1178)
NWVDVISDLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

N4D/E64Q (SEQ ID NO: 1179)
NWVDVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

D8N/D61N (SEQ ID NO: 1180)
NWVNVISNLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

D8N/E64Q (SEQ ID NO: 1181)
NWVNVISNLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

D61N/E64Q (SEQ ID NO: 1182)
NWVNVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVQMFINTS

E64Q/Q108E (SEQ ID NO: 1183)
NWVNVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVEMFINTS

N1D/N4D/D8N (SEQ ID NO: 1184)
DWVDVISNLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

D61N/E64Q/N65D (SEQ ID NO: 1185)
NWVNVISDLKKIEDLIQSMHIDATLYTESDVHPSCKVTAMKCFLLELQVISLESGDASIHNTVQDLIILANNSLSSNGNVTESGCKECEE
LEEKNIKEFLQSFVHIVQMFINTS

N1D/D61N/E64Q/Q108E (SEQ ID NO: 1186)
DWVNVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVEMFINTS

N4D/D61N/E64Q/Q108E (SEQ ID NO: 1187)
NWVDVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVEMFINTS

Figure 104BL

N1D/N65D (SEQ ID NO: 1188)
DWVNVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

N1D/Q108E (SEQ ID NO: 1189)
DWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVEMFINTS

N4D/N65D (SEQ ID NO: 1190)
NWVDVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

D30N/N65D (SEQ ID NO: 1191)
NWVNVISDLKKIEDLIQSMHIDATLYTESNVHPSCKVTAMKCFLLELQVISLESGDASIHDTVEDLIILANNSLSSNGNVTESGCKECEE
LEEKNIKEFLQSFVHIVQMFINTS

D30N/Q108E (SEQ ID NO: 1192)
NWVNVISDLKKIEDLIQSMHIDATLYTESNVHPSCKVTAMKCFLLELQVISLESGDASIHDTVENLIILANNSLSSNGNVTESGCKECEE
LEEKNIKEFLQSFVHIVEMFINTS

N65D/Q108E (SEQ ID NO: 1193)
NWVNVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVEMFINTS

E64Q/N65D (SEQ ID NO: 1194)
NWVNVISDLKKIEDLIQSMHIDATLYTESDVHPSCKVTAMKCFLLELQVISLESGDASIHDTVQDLIILANNSLSSNGNVTESGCKECEE
LEEKNIKEFLQSFVHIVQMFINTS

N1D/N4D/N65D (SEQ ID NO: 1195)
DWVDVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

D30N/E64Q/N65D (SEQ ID NO: 1196)
NWVNVISDLKKIEDLIQSMHIDATLYTESNVHPSCKVTAMKCFLLELQVISLESGDASIHDTVQDLIILANNSLSSNGNVTESGCKECEE
LEEKNIKEFLQSFVHIVQMFINTS

N4D/D61N/N65D (SEQ ID NO: 1197)
NWVDVISDLKKIEDLIQSMHIDATLYTESDVHPSCKVTAMKCFLLELQVISLESGDASIHNIVEDLIILANNSLSSNGNVTESGCKECEE
LEEKNIKEFLQSFVHIVQMFINTS

| Non-Xtend | Xtend | Format | Substitutions |
|---|---|---|---|
| 22822 | 23504 | IL-15/Rα-heteroFc | Q108E |
| 24045 | 24306 | IL-15/Rα-heteroFc | D30N/E64Q/N65D |
| 22821 | 23343 | IL-15/Rα-heteroFc | N65D |
| 23557 | 24113 | IL-15/Rα-heteroFc | N4D/N65D |
| 24051 | 24341 | IL-15/Rα-heteroFc | N1D/N65D |
| 24052 | 24301 | IL-15/Rα-heteroFc | N1D/N65D |
| 24342 | 24346 | bivalent ncIL-15/Rα-Fc | Q108E |
| 24349 | 24383 | ncIL-15/Rα-Fc | Q108E |

Figure 106

| XENP | Heterodimer-skewing variant, Chain 1 | Heterodimer-skewing variant, Chain 2 | Heterodimer Yield (%) | CH3 Tm (°C) |
|---|---|---|---|---|
| 12757 | none | none | 52.7 | 83.1 |
| 12758 | L368D/K370S | S364K | 94.4 | 76.6 |
| 12759 | L368D/K370S | S364K/E357L | 90.2 | 77.2 |
| 12760 | L368D/K370S | S364K/E357Q | 95.2 | 77.5 |
| 12761 | T411E/K360E/Q362E | D401K | 85.6 | 80.6 |
| 12496 | L368E/K370S | S364K | 91.5 | n.d. |
| 12511 | K370S | S364K | 59.9 | n.d. |
| 12840 | L368E/K370S | S364K/E357Q | 59.5 | n.d. |
| 12841 | K370S | S364K/E357Q | 90.4 | n.d. |
| 12894 | L368E/K370S | S364K | 41.0 | n.d. |
| 12895 | K370S | S364K | 49.3 | n.d. |
| 12896 | L368E/K370S | S364K/E357Q | 73.9 | n.d. |
| 12901 | K370S | S364K/E357Q | 87.9 | n.d. |

IL15/IL15Rα HETERODIMERIC FC-FUSION PROTEINS

PRIORITY CLAIM

This application claims priority to U.S. Ser. No. 62/408,655, filed Oct. 14, 2016, U.S. Ser. No. 62/416,087, filed Nov. 1, 2016, U.S. Ser. No. 62/443,465, filed Jan. 6, 2017, and U.S. Ser. No. 62/477,926, filed Mar. 28, 2017, which are expressly incorporated herein by reference in their entirety, with particular reference to the figures, legends and claims therein.

SEQUENCE LISTING

The instant application contains a Sequence Listing which has been submitted electronically in ASCII format and is hereby incorporated by reference in its entirety. Said ASCII copy, created on Jan. 16, 2018, is named 067461-5201-WO SL.txt and is 2,193,975 bytes in size.

BACKGROUND OF THE INVENTION

IL-2 and IL-15 function in aiding the proliferation and differentiation of B cells, T cells, and NK cells. IL-2 is also essential for regulatory T cell (Treg) function and survival. Both cytokines exert their cell signaling function through binding to a trimeric complex consisting of two shared receptors, the common gamma chain (γc; CD132) and IL-2 receptor B-chain (IL-2Rβ; CD122), as well as an alpha chain receptor unique to each cytokine: IL-2 receptor alpha (IL-2Rα; CD25) or IL-15 receptor alpha (IL-15Rα; CD215). Both cytokines are considered as potentially valuable therapeutics in oncology and IL-2 has been approved for use in patients with metastatic renal-cell carcinoma and malignant melanoma. Currently there are no approved uses of recombinant IL-15, although several clinical trials are ongoing.

IL-2 presents several challenges as a therapeutic agent. First, it preferentially activates T cells that express the high affinity receptor complex, which depends on CD25 expression. Because Treg cells constitutively express CD25, they compete for IL-2 supplies with effector T cells, whose activation is preferred for oncology treatment. This imbalance has led to the concept of high dose IL-2. However, this approach creates additional problems because of IL-2-mediated toxicities such as vascular leak syndrome.

IL-2 is secreted primarily by activated T cells, while its receptors are located on activated T cells, Tregs, NK cells, and B cells. In contrast, IL-15 is produced on monocytes and dendritic cells and is primarily presented as a membrane-bound heterodimeric complex with IL-15Rα present on the same cells. Its effects are realized through trans-presentation of the IL-15/IL-15Rα complex to NK cells and CD8+ T cells expressing IL-2Rβ and the common gamma chain.

As potential drugs, both cytokines suffer from a very fast clearance, with half-lives measured in minutes. In addition, IL-15 by itself is less stable due to its preference for the IL-15Rα-associated complex. It has also been shown that recombinantly produced IL15/IL15Rα heterodimer can potently activate T cells. Nevertheless, a short half-life hinders favorable dosing. The present invention solves this problem by providing novel IL15/IL15Rα heterodimer Fc fusion proteins.

BRIEF SUMMARY OF THE INVENTION

Accordingly, in one aspect the present invention provides a heterodimeric protein comprising a) a first fusion protein comprising a first protein domain and a first Fc domain, wherein the first protein domain is covalently attached to the N-terminus of the first Fc domain using a first domain linker; b) a second fusion protein comprising a second protein domain and a second Fc domain, wherein the second protein domain is covalently attached to the N-terminus of the Fc domain using a second domain linker; wherein the first and the second Fc domains have a set of amino acid substitutions selected from the group consisting of S267K/L368D/K370S:S267K/LS364K/E357Q; S364K/E357Q:L368D/K370S; L368D/K370S:S364K; L368E/K370S:S364K; T411T/E360E/Q362E:D401K; L368D/K370S:S364K/E357L and K370S:S364K/E357Q, according to EU numbering and wherein the first protein domain comprises an IL15 protein and the second protein domain comprises an IL15Rα protein. In some embodiments, the first protein domain is covalently attached to the N-terminus of the first Fc domain directly and without using the first domain linker and/or the second protein domain is covalently attached to the N-terminus of the second Fc domain directly and without using the second domain linker.

In some embodiments, the heterodimeric protein comprises: (i) the first fusion protein having a polypeptide sequence of SEQ ID NOS 52, 412, 418, 430 and 436 (15902) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (ii) the first fusion protein having a polypeptide sequence of SEQ ID NOS 52, 412, 418, 430 and 436 (15902) and the second fusion protein having a polypeptide sequence of SEQ ID NOS 421, 445 and 463 (15909), (iii) the first fusion protein having a polypeptide sequence of SEQ ID NOS 58, 424, 442 and 448 (16479) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (iv) the first fusion protein having a polypeptide sequence of SEQ ID NOS 52, 412, 418, 430 and 436 (15902) and the second fusion protein having a polypeptide sequence of SEQ ID NOS 61, 71, 267, 433, 451, 473, 952 and 958 (16481), (v) the first fusion protein having a polypeptide sequence of SEQ ID NOS 52, 412, 418, 430 and 436 (15902) and the second fusion protein having a polypeptide sequence of SEQ ID NO: 439 (16483), (vi) the first fusion protein having a polypeptide sequence of SEQ ID NOS 58, 424, 442 and 448 (16479) and the second fusion protein having a polypeptide sequence of SEQ ID NOS 421, 445 and 463 (15909), (vii) the first fusion protein having a polypeptide sequence of SEQ ID NOS 58, 424, 442 and 448 (16479) and the second fusion protein having a polypeptide sequence of SEQ ID NOS 61, 71, 267, 433, 451, 473, 952 and 958 (16481), (viii) the first fusion protein having a polypeptide sequence of SEQ ID NOS 454 and 460 (16480) and the second fusion protein having a polypeptide sequence of SEQ ID NO: 457 (16482), (ix) the first fusion protein having a polypeptide sequence of SEQ ID NOS 454 and 460 (16480) and the second fusion protein h having as a polypeptide sequence of SEQ ID NOS 421, 445 and 463 (15909), (x) the first fusion protein having a polypeptide sequence of SEQ ID NO:XX (17064) and the second fusion protein having a polypeptide sequence of SEQ ID NO: 599 (17038), (xi) the first fusion protein having a polypeptide sequence of SEQ ID NO:XX (17064) and the second fusion protein having a polypeptide sequence of SEQ ID NOS 167 and 609 (17040), (xii) the first fusion protein having a polypeptide sequence of SEQ ID NO:XX (17062) and the second fusion protein having a polypeptide sequence of SEQ ID NOS 172, 614 and 619 (17044), (xiii) the first fusion protein having a polypeptide sequence of SEQ ID NO: 729 (17686) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xiv) the first fusion protein having a polypeptide sequence of SEQ ID NO: 735 (17687) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xv) the first fusion protein having a polypeptide sequence of SEQ ID NO: 741 (17688) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xvi) the first fusion protein having a polypeptide sequence of SEQ ID NO: 747 (17689) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xvii) the first fusion protein having a polypeptide sequence of SEQ ID NO: 753 (17690) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xviii) the first fusion protein having a polypeptide sequence of SEQ ID NO: 759 (17691) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xix) the first fusion protein having a polypeptide sequence of SEQ ID NOS 228 and 765 (17692) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xx) the first fusion protein having a polypeptide sequence of SEQ ID NOS 234 and 771 (17693) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxi) the first fusion protein having a polypeptide sequence of SEQ ID NO: 777 (17694) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxii) the first fusion protein having a polypeptide sequence of SEQ ID NO: 783 (17695) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxiii) the first fusion protein having a polypeptide sequence of SEQ ID NO: 789 (17696) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxiv) the first fusion protein having a polypeptide sequence of SEQ ID NO: 795 (17697) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxv) the first fusion protein having a polypeptide sequence of SEQ ID NO: 801 (17698) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxvi) the first fusion protein having a polypeptide sequence of SEQ ID NO: 807 (17699) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxvii) the first fusion protein having a polypeptide sequence of SEQ ID NO: 819 (17701) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxviii) the first fusion protein having a polypeptide sequence of SEQ ID NO: 759 (17691) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxix) the first fusion protein having a polypeptide sequence of SEQ ID NO: 825 (17702) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxx) the first fusion protein having a polypeptide sequence of SEQ ID NO: 831 (17703) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxxi) the first fusion protein having a polypeptide sequence of SEQ ID NO: 837 (17704) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxxii) the first fusion protein having a polypeptide sequence of SEQ ID NO: 843 (17705) and the second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxxiii) said first fusion protein having a polypeptide sequence of SEQ ID NOS 358 and 859 (18295) and said second fusion protein having a polypeptide sequence of SEQ ID NOS 361 and 862 (17761), (xxxiv) said first fusion protein having a polypeptide sequence of SEQ ID NOS 240 and 881 (18783) and said second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxxv) said first fusion protein having a polypeptide sequence of SEQ ID NO: 887 (18784) and said second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxxvi) said first fusion protein having a polypeptide sequence of SEQ ID NOS 246 and 893 (18786) and said second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxxvii) said first fusion protein having a polypeptide sequence of SEQ ID NO: 899 (18788) and said second fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), (xxxviii) said first fusion protein having a polypeptide sequence of SEQ ID NOS 264 and 949 (19242) and said second fusion protein having a polypeptide sequence of SEQ ID NOS 61, 71, 267, 433, 451, 473, 952 and 958 (16481), or (xxxix) said first fusion protein having a polypeptide sequence of SEQ ID NO: 955 (19243) and said second fusion protein having a polypeptide sequence of SEQ ID NOS 61, 71, 267, 433, 451, 473, 952 and 958 (16481).

In some instances, the heterodimeric protein is selected from the group consisting of XENP20818, XENP20819, XENP21471, XENP21472, XENP21473, XENP21474, XENP21475, XENP21476, XENP21477, XENP22013, XENP22815, XENP22816, XENP22817, XENP22818, XENP22819, XENP22820, XENP22821, XENP22822, XENP22823, XENP22824, XENP22825, XENP22826, XENP22827, XENP22828, XENP22829, XENP22830, XENP22831, XENP22832, XENP22833, XENP22834, XENP23343, XENP23554, XENP23555, XENP23557, XENP23559, XENP24019, and XENP24020.

In a further aspect, the invention provides a heterodimeric protein comprising: a) a fusion protein comprising a first protein domain, a second protein domain, and a first Fc domain, wherein the first protein domain is covalently attached to the N-terminus of the second protein domain using a first domain linker, and wherein the second protein domain is covalently attached to the N-terminus of the first Fc domain using a second domain linker; b) a second Fc domain; wherein the first and the second Fc domains have a set of amino acid substitutions selected from the group consisting of S267K/L368D/K370S:S267K/LS364K/E357Q; S364K/E357Q:L368D/K370S; L368D/K370S:S364K; L368E/K370S:S364K; T411T/E360E/Q362E:D401K; L368D/K370S:S364K/E357L and K370S:S364K/E357Q, according to EU numbering and wherein the first protein domain comprises an IL15Rα protein and the second protein domain comprises an IL15 protein.

In some embodiments, the first fusion protein has a polypeptide sequence of SEQ ID NOS 64 and 466 (16478) and the Fc domain has a polypeptide sequence of SEQ ID NOS 68 and 470 (8924). The heterodimeric protein can be XENP21478.

In another aspect, the invention provides a heterodimeric protein comprising: a) a fusion protein comprising a first protein domain and a first Fc domain, wherein the first protein domain is covalently attached to the N-terminus of the first Fc domain using a domain linker; b) a second Fc domain; and c) a second protein domain noncovalently attached to the first protein domain; wherein the first and the second Fc domains have a set of amino acid substitutions selected from the group consisting of S267K/L368D/K370S:S267K/LS364K/E357Q; S364K/E357Q:L368D/K370S; L368D/K370S:S364K; L368E/K370S:S364K; T411T/E360E/Q362E:D401K; L368D/K370S:S364K/E357L and K370S:S364K/E357Q, according to EU numbering and wherein the first protein domain comprises an IL15Rα and the second protein domain comprises an IL15 protein.

In some embodiments, the heterodimer protein comprises: (i) the fusion protein having a polypeptide sequence of SEQ ID NOS 61, 71, 267, 433, 451, 473, 952 and 958 (16481), the second Fc domain having a polypeptide sequence of SEQ ID NOS 70, 75, 161, 166, 171, 472, 583, 588, 593, 598, 603, 608, 613, 618, 623, 628, 633, 638 and 643 (8793), and a second protein domain having a polypeptide sequence of SEQ ID NOS 69, 74, 87, 96, 121, 471, 479, 529, 531, 533, 535, 582, 587, 592, 642 and 667 (16484); (ii) the fusion protein having a polypeptide sequence of SEQ ID NO: 584 (17034), the second Fc domain having a polypeptide sequence of SEQ ID NOS 70, 75, 161, 166, 171, 472, 583, 588, 593, 598, 603, 608, 613, 618, 623, 628, 633, 638 and 643 (8793), and a second protein domain having a polypeptide sequence of SEQ ID NOS 69, 74, 87, 96, 121, 471, 479, 529, 531, 533, 535, 582, 587, 592, 642 and 667 (16484); (iii) the fusion protein having a polypeptide sequence of SEQ ID NO: 599 (17038), the second Fc domain having a polypeptide sequence of SEQ ID NOS 70, 75, 161, 166, 171, 472, 583, 588, 593, 598, 603, 608, 613, 618, 623, 628, 633, 638 and 643 (8793), and a second protein domain having a polypeptide sequence of SEQ ID NOS 69, 74, 87, 96, 121, 471, 479, 529, 531, 533, 535, 582, 587, 592, 642 and 667 (16484); (iv) the fusion protein having a polypeptide sequence of SEQ ID NO: 594 (17036), the second Fc domain having a polypeptide sequence of SEQ ID NOS 70, 75, 161, 166, 171, 472, 583, 588, 593, 598, 603, 608, 613, 618, 623, 628, 633, 638 and 643 (8793), and a second protein domain having a polypeptide sequence of SEQ ID NOS 69, 74, 87, 96, 121, 471, 479, 529, 531, 533, 535, 582, 587, 592, 642 and 667 (16484); (v) the fusion protein having a polypeptide sequence of SEQ ID NO: 599 (17038), the second Fc domain having a polypeptide sequence of SEQ ID NOS 70, 75, 161, 166, 171, 472, 583, 588, 593, 598, 603, 608, 613, 618, 623, 628, 633, 638 and 643 (8793), and a second protein domain having a polypeptide sequence of SEQ ID NOS 123, 125, 127, 160, 165, 182, 186, 195, 537, 539, 541, 597, 602, 607, 654, 658 and 677 (17074); (vi) the fusion protein having a polypeptide sequence of SEQ ID NOS 162 and 604 (17039), the second Fc domain having a polypeptide sequence of SEQ ID NOS 70, 75, 161, 166, 171, 472, 583, 588, 593, 598, 603, 608, 613, 618, 623, 628, 633, 638 and 643 (8793), and a second protein domain having a polypeptide sequence of SEQ ID NOS 123, 125, 127, 160, 165, 182, 186, 195, 537, 539, 541, 597, 602, 607, 654, 658 and 677 (17074); (vii) the fusion protein having a polypeptide sequence of SEQ ID NOS 167 and 609 (17040), the second Fc domain having a polypeptide sequence of SEQ ID NOS 70, 75, 161, 166, 171, 472, 583, 588, 593, 598, 603, 608, 613, 618, 623, 628, 633, 638 and 643 (8793), and a second protein domain having a polypeptide sequence of SEQ ID NOS 123, 125, 127, 160, 165, 182, 186, 195, 537, 539, 541, 597, 602, 607, 654, 658 and 677 (17074); (viii) the fusion protein having a polypeptide sequence of SEQ ID NOS 172, 614 and 619 (17044), the second Fc domain having a polypeptide sequence of SEQ ID NOS 70, 75, 161, 166, 171, 472, 583, 588, 593, 598, 603, 608, 613, 618, 623, 628, 633, 638 and 643 (8793), and a second protein domain having a polypeptide sequence of SEQ ID NOS 543 and 612 (17071); (ix) the fusion protein having a polypeptide sequence of SEQ ID NOS 172, 614 and 619 (17044), the second Fc domain having a polypeptide sequence of SEQ ID NOS 70, 75, 161, 166, 171, 472, 583, 588, 593, 598, 603, 608, 613, 618, 623, 628, 633, 638 and 643 (8793), and a second protein domain having a polypeptide sequence of SEQ ID NOS 170, 190, 545, 617 and 662 (17072); (x) the fusion protein having a polypeptide sequence of SEQ ID NOS 547 and 622 (17075), the second Fc domain having a polypeptide sequence of SEQ ID NOS 70, 75, 161, 166, 171, 472, 583, 588, 593, 598, 603, 608, 613, 618, 623, 628, 633, 638 and 643 (8793), and a second protein domain having a polypeptide sequence of SEQ ID NO: 624 (17041); (xi) the fusion protein having a polypeptide sequence of SEQ ID NO: 629 (17043), the second Fc domain having a polypeptide sequence of SEQ ID NOS 70, 75, 161, 166, 171, 472, 583, 588, 593, 598, 603, 608, 613, 618, 623, 628, 633, 638 and 643 (8793), and a second protein domain having a polypeptide sequence of SEQ ID NOS 549 and 627 (17070); (xii) the fusion protein having a polypeptide sequence of SEQ ID NO: 634 (17045), the second Fc domain having a polypeptide sequence of SEQ ID NOS 70, 75, 161, 166, 171, 472, 583, 588, 593, 598, 603, 608, 613, 618, 623, 628, 633, 638 and 643 (8793), and a second protein domain having a polypeptide sequence of SEQ ID NOS 551 and 632 (17073); (xiii) the fusion protein having a polypeptide sequence of SEQ ID NO: 639 (17042), the second Fc domain having a polypeptide sequence of SEQ ID NOS 70, 75, 161, 166, 171, 472, 583, 588, 593, 598, 603, 608, 613, 618, 623, 628, 633, 638 and 643 (8793), and a second protein domain having a polypeptide sequence of SEQ ID NOS 553 and 637 (17083); or (xiv) the fusion protein having a polypeptide sequence of SEQ ID NOS 55, 76, 231, 237, 243, 249, 415, 427, 644, 732, 738, 744, 750, 756, 762, 768, 774, 780, 786, 792, 798, 804, 810, 816, 822, 828, 834, 840, 846, 884, 890, 896 and 902 (15908), the second Fc domain having a polypeptide sequence of SEQ ID NOS 70, 75, 161, 166, 171, 472, 583, 588, 593, 598, 603, 608, 613, 618, 623, 628, 633, 638 and 643 (8793), and a second protein domain having a polypeptide sequence of SEQ ID NOS 69, 74, 87, 96, 121, 471, 479, 529, 531, 533, 535, 582, 587, 592, 642 and 667 (16484). The heterodimer protein can be selected from the group consisting of XENP21479, XENP22357, XENP22354, XENP22355, XENP22356, XENP22357, XENP22358, XENP22359, XENP22360, XENP22361, XENP22362, XENP22363, XENP22364, XENP22365, XENP22366, and XENP22637.

In an additional aspect, the invention provides a heterodimeric protein comprising: a) a first fusion protein comprising a first protein domain and a first Fc domain, wherein the first protein domain is covalently attached to the N-terminus of said first Fc domain using a domain linker; b) a second fusion protein comprising a second heavy chain comprising a second protein domain and a first second heavy chain comprising a second Fc domain, wherein the second protein domain is covalently attached to the C-terminus of the second Fc domain using a domain linker; c) a third protein domain noncovalently attached to the first protein domain of the first fusion protein; and d) a fourth protein domain noncovalently attached to the second protein domain of the second fusion protein, wherein the first and the second Fc domains have a set of amino acid substitutions selected from the group consisting of S267K/L368D/K370S:S267K/LS364K/E357Q; S364K/E357Q:L368D/K370S; L368D/K370S:S364K; L368E/K370S:S364K; T411T/E360E/Q362E:D401K; L368D/K370S:S364K/E357L and K370S:S364K/E357Q, according to EU numbering and wherein the first protein domain and the second protein domain comprise an IL15Rα protein, and wherein the third protein domain and the fourth protein domain comprises an IL15 protein.

In some embodiments, the heterodimer protein comprises (i) the first fusion protein has a polypeptide sequence of SEQ ID NOS 84, 476 and 480 (17023) the second fusion protein has a polypeptide sequence of SEQ ID NOS 84, 476 and 480 (17023), the third protein domain has a polypeptide sequence of SEQ ID NOS 69, 74, 87, 96, 121, 471, 479, 529, 531, 533, 535, 582, 587, 592, 642 and 667 (16484), and the fourth protein domain has a polypeptide sequence of SEQ ID NOS 69, 74, 87, 96, 121, 471, 479, 529, 531, 533, 535, 582, 587, 592, 642 and 667 (16484) or (ii) the first fusion protein has a polypeptide sequence of SEQ ID NOS 179 and 651 (17581), the second fusion protein has a polypeptide sequence of SEQ ID NOS 179 and 651 (17581), the third protein domain has a polypeptide sequence of SEQ ID NOS 123, 125, 127, 160, 165, 182, 186, 195, 537, 539, 541, 597, 602, 607, 654, 658 and 677 (17074), and the fourth protein domain has a polypeptide sequence of SEQ ID NOS 123, 125, 127, 160, 165, 182, 186, 195, 537, 539, 541, 597, 602, 607, 654, 658 and 677 (17074). The heterodimer protein can be XENP21978 or XENP22634.

In an additional aspect, the invention provides a heterodimeric protein comprising: a) a first fusion protein comprising a first Fc domain and a first protein domain, wherein the first Fc domain is covalently attached to the N-terminus of the first protein domain using a domain linker; b) a second Fc domain, and c) a second protein domain noncovalently attached to the first protein domain of the first fusion protein; wherein the first and the second Fc domains have a set of amino acid substitutions selected from the group consisting of S267K/L368D/K370S:S267K/LS364K/E357Q; S364K/E357Q:L368D/K370S; L368D/K370S:S364K; L368E/K370S:S364K; T411T/E360E/Q362E:D401K; L368D/K370S: S364K/E357L and K370S: S364K/E357Q, according to EU numbering and wherein the first protein domain comprises an IL15Rα protein and the second protein domain comprises an IL15 protein.

In some embodiments, the heterodimer protein comprises (i) the first fusion protein having a polypeptide sequence of SEQ ID NOS 92 and 663 (17603), the second Fc domain having a polypeptide sequence of SEQ ID NOS 95, 101, 194, 666, 676 and 1113 (8927), and the second protein domain having a polypeptide sequence of SEQ ID NOS 69, 74, 87, 96, 121, 471, 479, 529, 531, 533, 535, 582, 587, 592, 642 and 667 (16484); or ii) the first fusion protein having a polypeptide sequence of SEQ ID NOS 191 and 673 (17605), the second Fc domain having a polypeptide sequence of SEQ ID NOS 95, 101, 194, 666, 676 and 1113 (8927), and the second protein domain having a polypeptide sequence of SEQ ID NOS 123, 125, 127, 160, 165, 182, 186, 195, 537, 539, 541, 597, 602, 607, 654, 658 and 677 (17074).

In any of the embodiments of the present invention, the first and/or the second Fc domains can have an additional set of amino acid substitutions comprising Q295E/N384D/Q418E/N421D, according to EU numbering. In some cases, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

In any of the embodiments of the present invention, the IL15 protein has a polypeptide sequence selected from the group consisting of SEQ ID NO:1 (full-length human IL15) and SEQ ID NO:2 (truncated human IL15), and the IL15Rα protein has a polypeptide sequence selected from the group consisting of SEQ ID NO:3 (full-length human IL15Rα) and SEQ ID NO:4 (sushi domain of human IL15Rα). In some cases, the IL15 protein and the IL15Rα protein have a set of amino acid substitutions or additions selected from the group consisting of E87C:D96/P97/C98; E87C:D96/C97/A98; V49C:S40C; L52C:S40C; E89C:K34C; Q48C:G38C; E53C:L42C; C42S:A37C; and L45C:A37C, respectively.

In an additional aspect, the present invention provides a heterodimeric protein selected from the group consisting of XENP20818, XENP20819, XENP21471, XENP21472, XENP21473, XENP21474, XENP21475, XENP21476, XENP21477, XENP21478, XENP21479, XENP21978, XENP22013, XENP22015, XENP22017, XENP22354, XENP22355, XENP22356, XENP22357, XENP22358, XENP22359, XENP22360, XENP22361, XENP22362, XENP22363, XENP22364, XENP22365, XENP22366, XENP22637, and XENP22639. In some aspects, the present invention provides a heterodimeric protein selected from the group consisting of XENP20818, XENP20819, XENP21471, XENP21472, XENP21473, XENP21474, XENP21475, XENP21476, XENP21477, XENP22013, XENP22815, XENP22816, XENP22817, XENP22818, XENP22819, XENP22820, XENP22821, XENP22822, XENP22823, XENP22824, XENP22825, XENP22826, XENP22827, XENP22828, XENP22829, XENP22830, XENP22831, XENP22832, XENP22833, XENP22834, XENP23343, XENP23554, XENP23555, XENP23557, XENP23559, XENP24019, and XENP24020. Nucleic acids, expression vectors and host cells are all provided as well, in addition to methods of making these proteins and treating patients with them.

BRIEF DESCRIPTION OF THE DRAWINGS

FIGS. 2A-2B depict the sequences for IL-15 and its receptors. FIG. 2A shows the sequences for human IL-15, human IL-15Rα and human IL-15Rβ. FIG. 2A shows the sequences for the human common gamma receptor.

FIGS. 3A-3E depict useful pairs of Fc heterodimerization variant sets (including skew and pI variants). On FIGS. 3D and 3E, there are variants for which there are no corresponding "monomer 2" variants; these are pI variants which can be used alone on either monomer.

FIG. 4 depict a list of isosteric variant antibody constant regions and their respective substitutions. pI_(−) indicates lower pI variants, while pI_(+) indicates higher pI variants. These can be optionally and independently combined with other heterodimerization variants of the inventions (and other variant types as well, as outlined herein).

FIG. 5 depict useful ablation variants that ablate FcγR binding (sometimes referred to as "knock outs" or "KO" variants). Generally, ablation variants are found on both monomers, although in some cases they may be on only one monomer.

FIGS. 6A-6E show a particularly useful embodiments of "non-cytokine" components of the invention.

FIG. 7 depicts a number of exemplary variable length linkers. In some embodiments, these linkers find use linking the C-terminus of IL-15 and/or IL-15Rα(sushi) to the N-terminus of the Fc region. In some embodiments, these linkers find use fusing IL-15 to the IL-15Rα(sushi).

FIGS. 8A-8E show the sequences of several useful IL-15/Rα-Fc format backbones based on human IgG1, without the cytokine sequences (e.g., the Il-15 and/or IL-15Rα(sushi)). Backbone 1 is based on human IgG1 (356E/358M allotype), and includes C220S on both chain, the S364K/E357Q: L368D/K370S skew variants, the Q295E/N384D/Q418E/ N421D pI variants on the chain with L368D/K370S skew variants and the E233P/L234V/L235A/G236del/S267K ablation variants on both chains. Backbone 2 is based on human IgG1 (356E/358M allotype), and includes C220S on both chain, the S364K: L368D/K370S skew variants, the Q295E/N384D/Q418E/N421D pI variants on the chain with L368D/K370S skew variants and the E233P/L234V/L235A/G236del/S267K ablation variants on both chains. Backbone 3 is based on human IgG1 (356E/358M allotype), and includes C220S on both chain, the S364K: L368E/K370S skew variants, the Q295E/N384D/Q418E/N421D pI variants on the chain with L368E/K370S skew variants and the E233P/L234V/L235A/G236del/S267K ablation variants on both chains. Backbone 4 is based on human IgG1 (356E/358M allotype), and includes C220S on both chain, the D401K: K360E/Q362E/T411E skew variants, the Q295E/N384D/Q418E/N421D pI variants on the chain with K360E/Q362E/T411E skew variants and the E233P/L234V/L235A/G236del/S267K ablation variants on both chains. Backbone 5 is based on human IgG1 (356D/358L allotype), and includes C220S on both chain, the S364K/E357Q: L368D/K370S skew variants, the Q295E/N384D/Q418E/N421D pI variants on the chain with L368D/K370S skew variants and the E233P/L234V/L235A/G236del/S267K ablation variants on both chains. Backbone 6 is based on human IgG1 (356E/358M allotype), and includes C220S on both chain, the S364K/E357Q: L368D/K370S skew variants, Q295E/N384D/Q418E/N421D pI variants on the chain with L368D/K370S skew variants and the E233P/L234V/L235A/G236del/S267K ablation variants on both chains, as well as an N297A variant on both chains. Backbone 7 is identical to 6 except the mutation is N297S. Alternative formats for backbones 6 and 7 can exclude the ablation variants E233P/L234V/L235A/G236del/S267K in both chains. Backbone 8 is based on human IgG4, and includes the S364K/E357Q: L368D/K370S skew variants, the Q295E/N384D/Q418E/N421D pI variants on the chain with L368D/K370S skew variants, as well as a S228P (EU numbering, this is S241P in Kabat) variant on both chains that ablates Fab arm exchange as is known in the art. Backbone 9 is based on human IgG2, and includes the S364K/E357Q: L368D/K370S skew variants, the Q295E/N384D/Q418E/N421D pI variants on the chain with L368D/K370S skew variants. Backbone 10 is based on human IgG2, and includes the S364K/E357Q: L368D/K370S skew variants, the Q295E/N384D/Q418E/N421D pI variants on the chain with L368D/K370S skew variants as well as a S267K variant on both chains. Backbone 11 is identical to backbone 1, except it includes M428L/N434S Xtend mutations. Backbone 12 is based on human IgG1 (356E/358M allotype), and includes C220S on both identical chain, the E233P/L234V/L235A/G236del/S267K ablation variants on both identical chains. Backbone 13 is based on human IgG1 (356E/358M allotype), and includes C220S on both chain, the S364K/E357Q: L368D/K370S skew variants, the P217R/P229R/N276K pI variants on the chain with S364K/E357Q skew variants and the E233P/L234V/L235A/G236del/S267K ablation variants on both chains.

Figure 1:
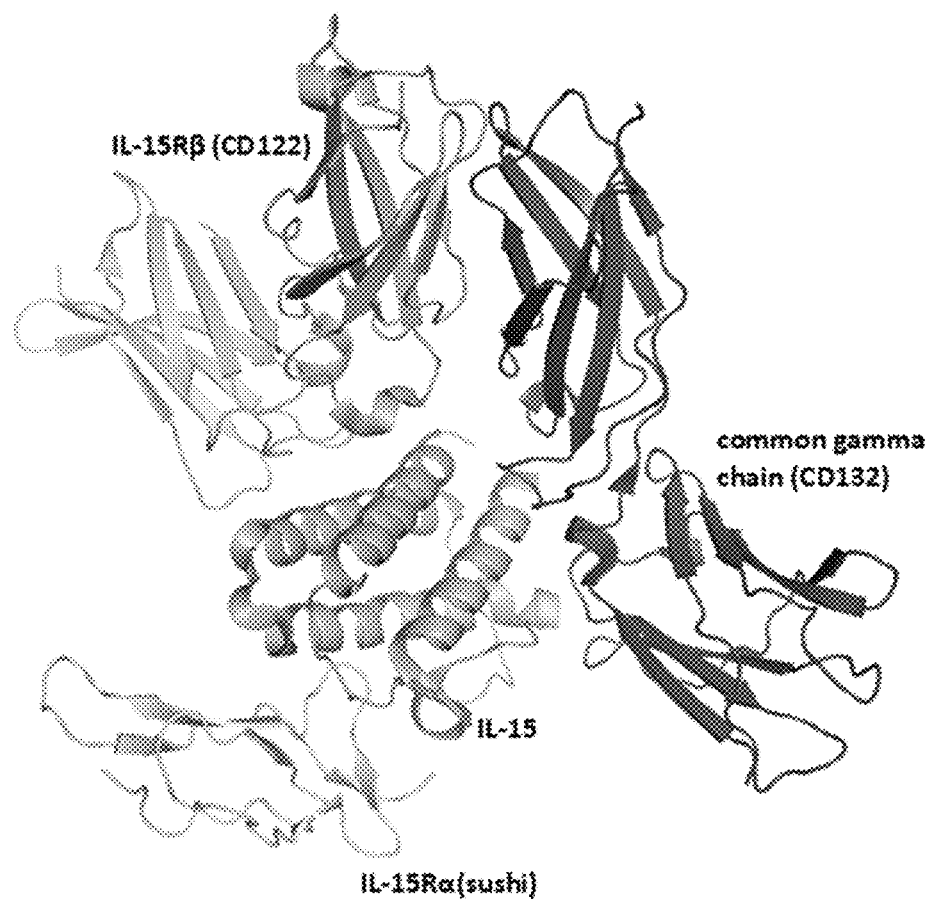
FIG. 1 depicts the structure of IL-15 in complex with its receptors IL-15Rα (CD215), IL-15Rβ (CD122), and the common gamma chain (CD132).

As will be appreciated by those in the art and outlined below, these sequences can be used with any IL-15 and IL-15Rα(sushi) pairs outlined herein, including but not limited to IL-15/Rα-heteroFc, ncIL-15/Rα, scIL-15/Rα, and dsIL-15/Rα as schematically depicted in FIGS. 9A-9G, and FIGS. 39A-39D. Additionally, any IL-15 and/or IL-15Rα (sushi) variants can be incorporated into these FIGS. 8A-8E backbones in any combination.

Included within each of these backbones are sequences that are 90%, 95%, 98% and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure (FIG. 8).

FIGS. 9A-9G depict several formats for the IL-15/Rα-Fc fusion proteins of the present invention. IL-15Rα Heterodimeric Fc fusion or "IL-15/Rα-heteroFc" (FIG. 9A) comprises IL-15 recombinantly fused to one side of a heterodimeric Fc and IL-15Rα(sushi) recombinantly fused to the other side of a heterodimeric Fc. The IL-15 and IL-15Rα (sushi) may have a variable length Gly-Ser linker between the C-terminus and the N-terminus of the Fc region. Single-chain IL-15/Rα-Fc fusion or "scIL-15/Rα-Fc" (FIG. 9B) comprises IL-15Rα(sushi) fused to IL-15 by a variable length linker (termed a "single-chain" IL-15/IL-15Rα(sushi) complex or "scIL-15/Rα") which is then fused to the N-terminus of a heterodimeric Fc-region, with the other side of the molecule being "Fc-only" or "empty Fc". Non-covalent IL-15/Rα-Fc or "ncIL-15/Rα-Fc" (FIG. 9C) comprises IL-15Rα(sushi) fused to a heterodimeric Fc region, while IL-15 is transfected separately so that a non-covalent IL-15/Rα complex is formed, with the other side of the molecule being "Fc-only" or "empty Fc". Bivalent non-covalent IL-15/Rα-Fc fusion or "bivalent ncIL-15/Rα-Fc" (FIG. 9D) comprises IL-15Rα(sushi) fused to the N-terminus of a homodimeric Fc region, while IL-15 is transfected separately so that a non-covalent IL-15/Rα complex is formed. Bivalent single-chain IL-15/Rα-Fc fusion or "bivalent scIL-15/Rα-Fc" (FIG. 9E) comprises IL-15 fused to IL-15Rα(sushi) by a variable length linker (termed a "single-chain" IL-15/IL-15Rα(sushi) complex or "scIL-15/Rα") which is then fused to the N-terminus of a homodimeric Fc-region. Fc-non-covalent IL-15/Rα fusion or "Fc-ncIL-15/Rα" (FIG. 9F) comprises IL-15Rα(sushi) fused to the C-terminus of a heterodimeric Fc region, while IL-15 is transfected separately so that a non-covalent IL-15/Rα complex is formed, with the other side of the molecule being "Fc-only" or "empty Fc". Fc-single-chain IL-15/Rα fusion or "Fc-scIL-15/Rα" (FIG. 9G) comprises IL-15 fused to IL-15Rα(sushi) by a variable length linker (termed a "single-chain" IL-15/IL-15Rα(sushi) complex or "scIL-15/Rα") which is then fused to the C-terminus of a heterodimeric Fc region, with the other side of the molecule being "Fc-only" or "empty Fc".

FIG. 10 depicts sequences of XENP20818 and XENP21475, illustrative IL-15/Rα-Fc fusion proteins of the "IL-15/Rα-heteroFc" format, with additional sequences being listed as XENPs 20819, 21471, 21472, 21473, 21474, 21476, and 21477 in the sequence listing. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIG. 11 depicts sequences of XENP21478, an illustrative IL-15/Rα-Fc fusion protein of the "scIL-15/Rα-Fc" format, with additional sequences being listed as XENPs 21993, 21994, 21995, 23174, 23175, 24477, and 24480 in the sequence listing. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIGS. 12A-12B depict sequences of XENP21479, XENP22366 and XENP24348, illustrative IL-15/Rα-Fc fusion proteins of the "ncIL-15/Rα-Fc" format. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIG. 13 depicts sequences of XENP21978, an illustrative IL-15/Rα-Fc fusion protein of the "bivalent ncIL-15/Rα-Fc" format, with additional sequences being listed as XENP21979 in the sequence listing. IL-15 and IL-15Rα (sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIG. 14 depicts sequences of an illustrative IL-15/Rα-Fc fusion protein of the "bivalent scIL-15/Rα-Fc" format. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIG. 15 depicts sequences of XENP22637, an illustrative IL-15/Rα-Fc fusion protein of the "Fc-ncIL-15/Rα" format, with additional sequences being listed as XENP22638 in the sequence listing. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIG. 16 depicts sequences of an illustrative IL-15/Rα-Fc fusion protein of the "Fc-scIL-15/Rα" format. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIGS. 17A-17E depict A) the IL-15/Rα-Fc fusion protein format for XENP20818, the purity and homogeneity of XENP20818 as determined by B) SEC and C) CEF, D) the affinity of XENP20818 for IL-2Rβ as determined by Octet, and E) the stability of XENP20818 as determined by DSF FIGS. 18A-18E depict A) the IL-15/Rα-Fc fusion protein format for XENP21478, the purity and homogeneity of XENP21478 as determined by B) SEC and C) CEF, D) the affinity of XENP21478 for IL-2Rβ as determined by Octet, and E) the stability of XENP21478 as determined by DSF.

FIGS. 19A-19E depicts A) the IL-15/Rα-Fc fusion protein format for XENP21479, the purity and homogeneity of XENP21479 as determined by B) SEC and C) CEF, D) the affinity of XENP21479 for IL-2Rβ as determined by Octet, and E) the stability of XENP21479 as determined by DSF.

Figure 20A:
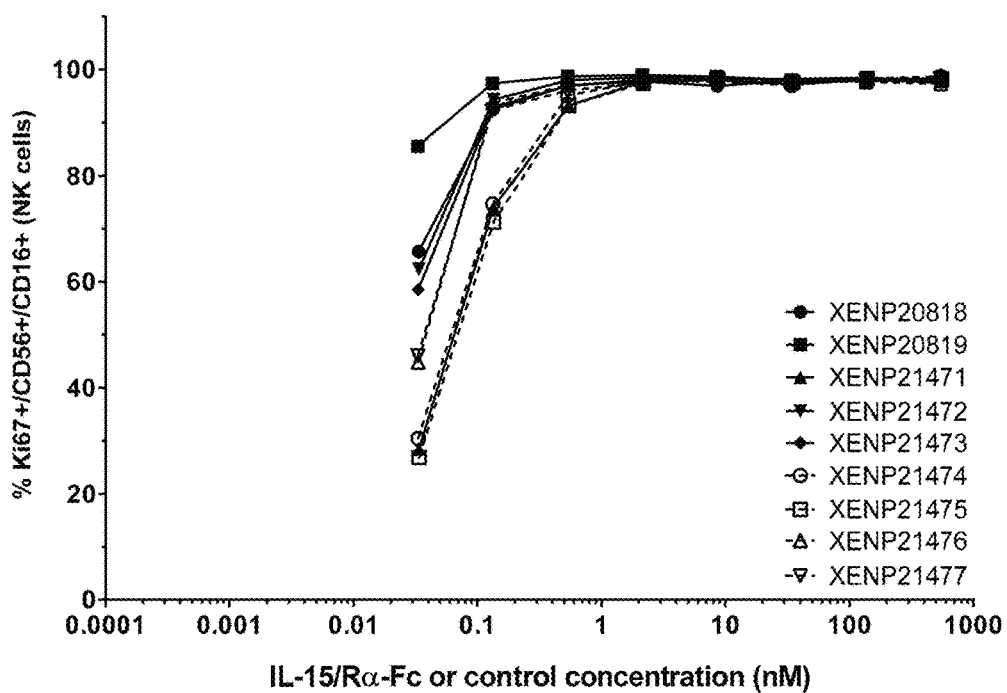
Figure 20B:
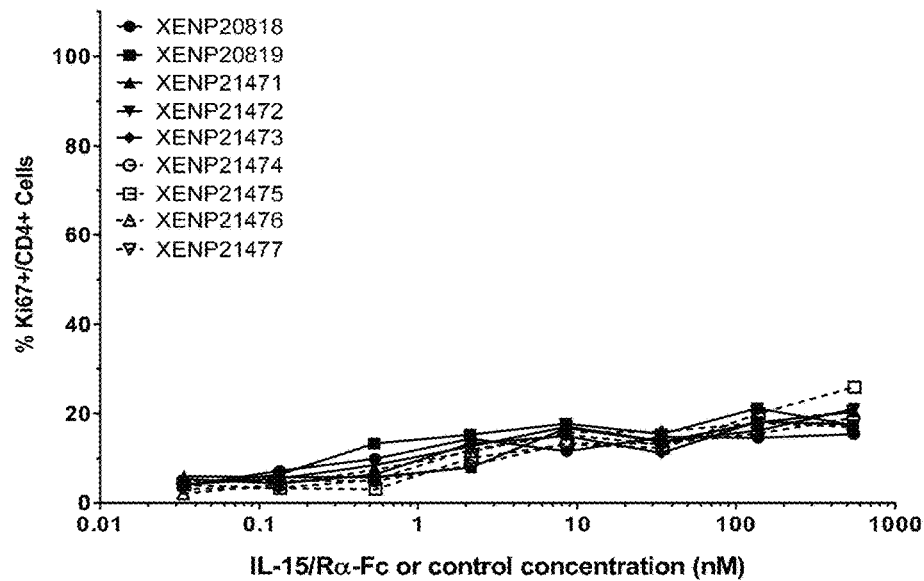
Figure 20C:
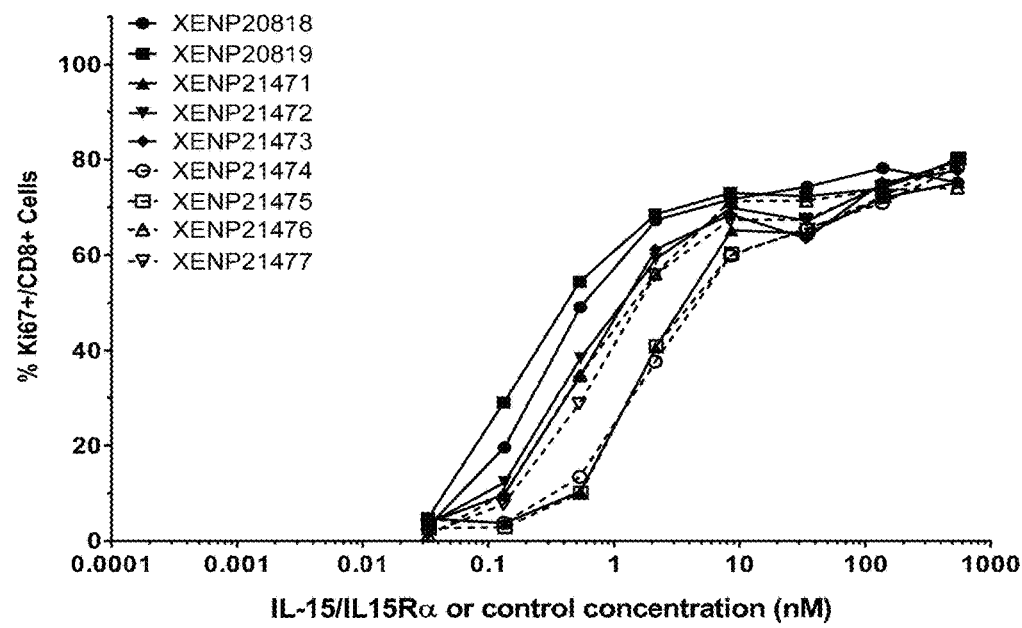

FIGS. 20A-20C depict the induction of A) NK (CD56+/CD16+) cells, B) CD4+ T cells, and C) CD8+ T cells proliferation by illustrative IL-15/Rα-Fc fusion proteins of the IL-15/Rα-heteroFc format with different linker lengths based on Ki67 expression as measured by FACS.

Figure 21A:
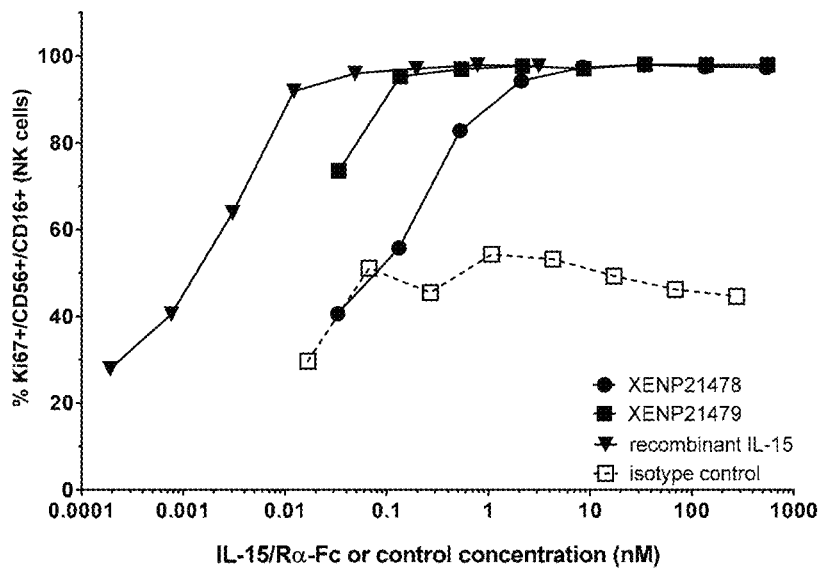
Figure 21B:
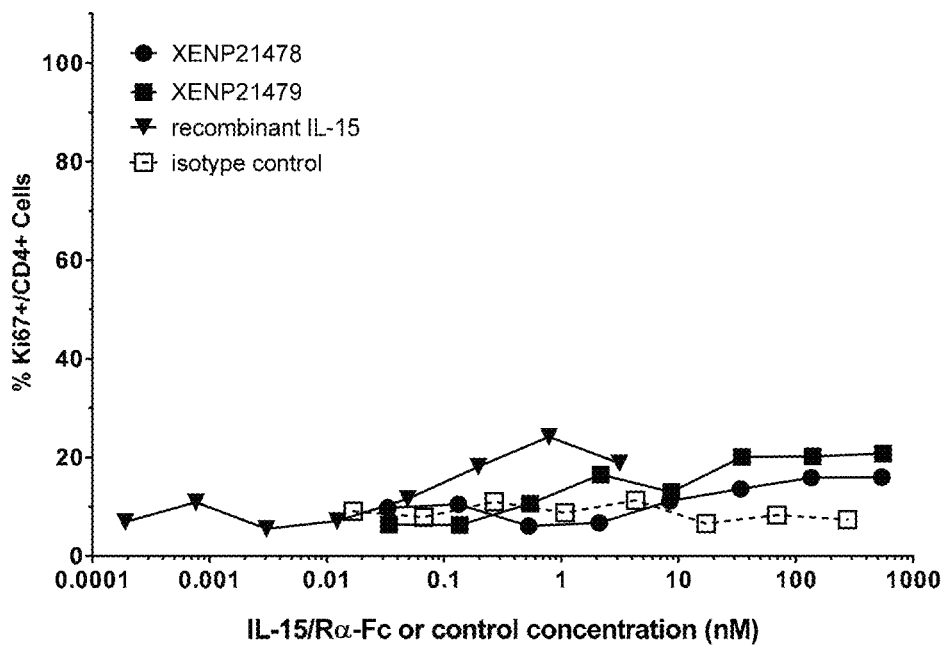
Figure 21C:
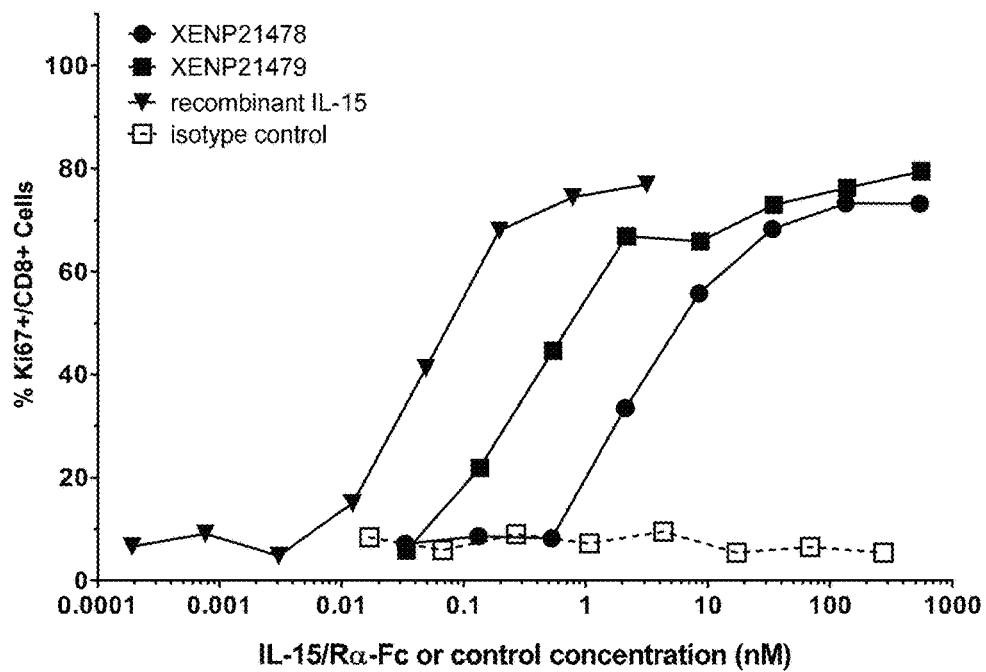

FIGS. 21A-21C depict the induction of A) NK (CD56+/CD16+) cells, B) CD4+ T cells, and C) CD8+ T cells proliferation by illustrative IL-15/Rα-Fc fusion proteins of the scIL-15/Rα-Fc format (XENP21478) and the ncIL-15/Rα-Fc format (XENP21479) based on Ki67 expression as measured by FACS.

Figure 22:
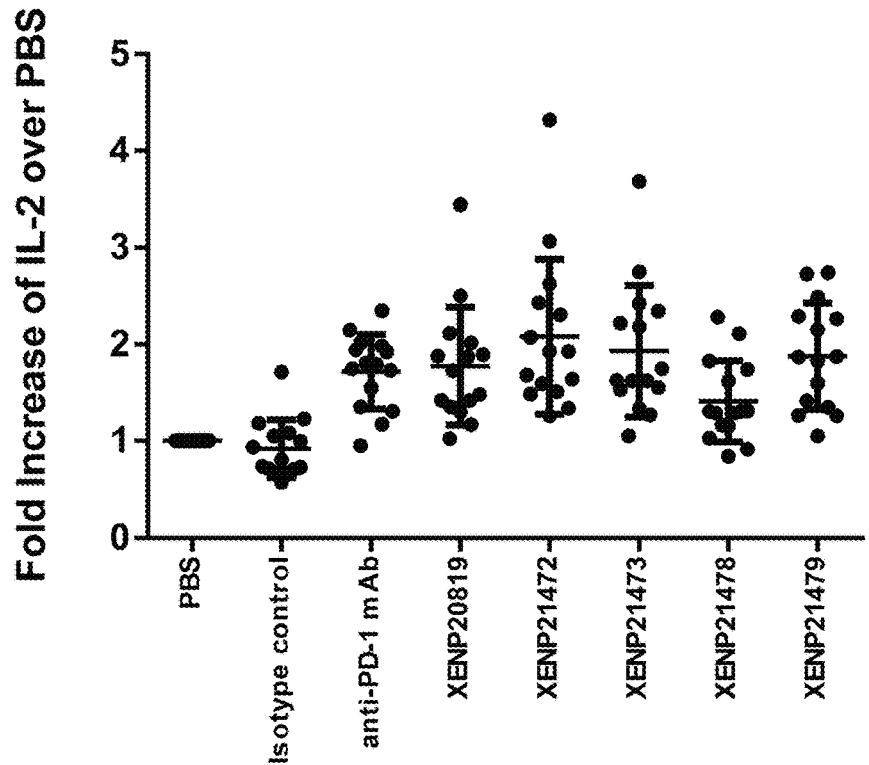

FIG. 22 depicts enhancement of IL-2 secretion by illustrative IL-15/Rα-Fc fusion proteins, an isotype control, and a bivalent anti-PD-1 antibody over PBS control in an SEB-stimulated PBMC assay.

Figure 23:
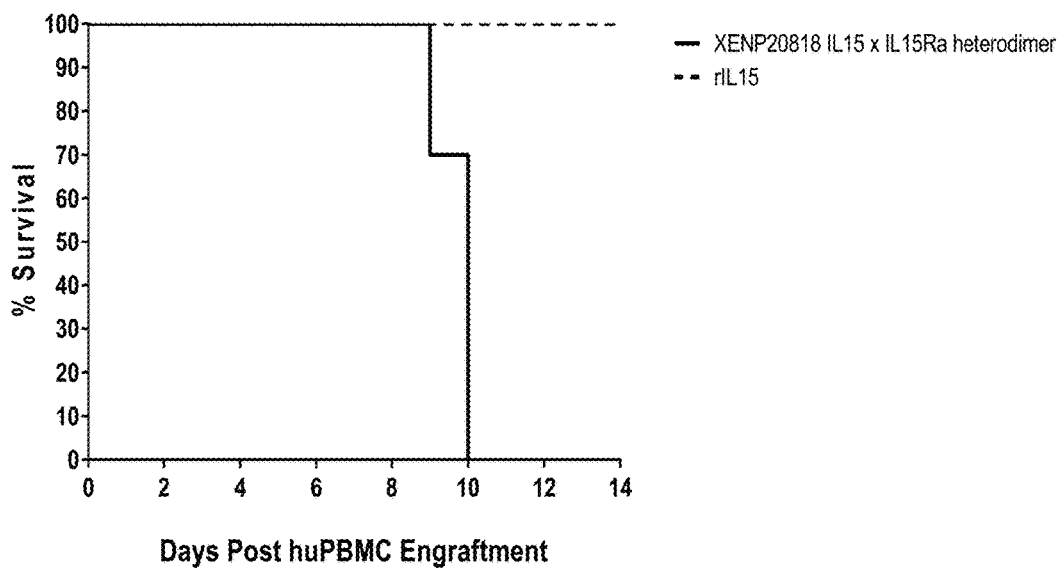

FIG. 23 depicts the survival curve for PBMC-engrafted NSG mice following treatment with XENP20818 and recombinant IL-15.

Figure 24:
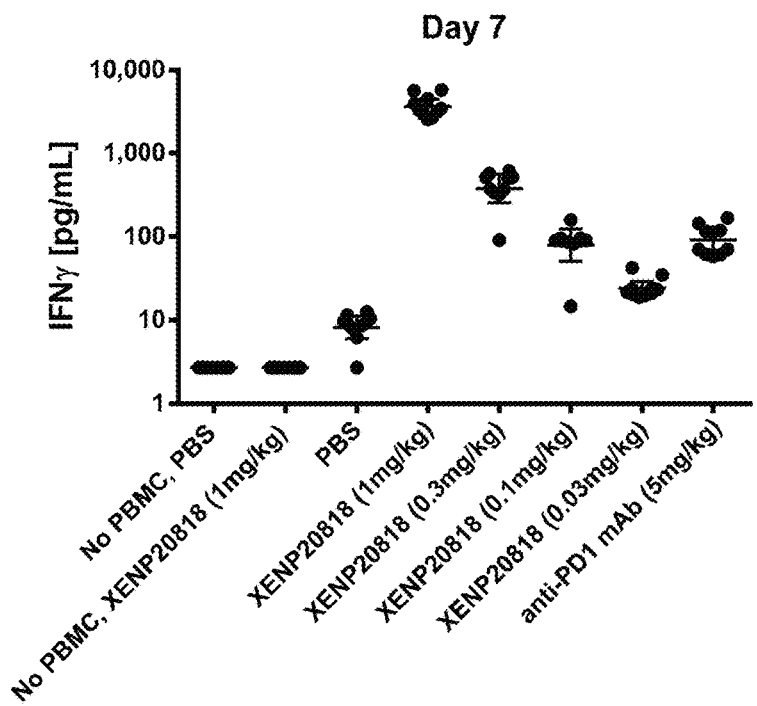

FIG. 24 depicts the concentration of IFNγ in serum of NSG mice on Day 7 after engraftment with human PBMCs and treatment with XENP20818 at the indicated concentrations.

Figure 25A:
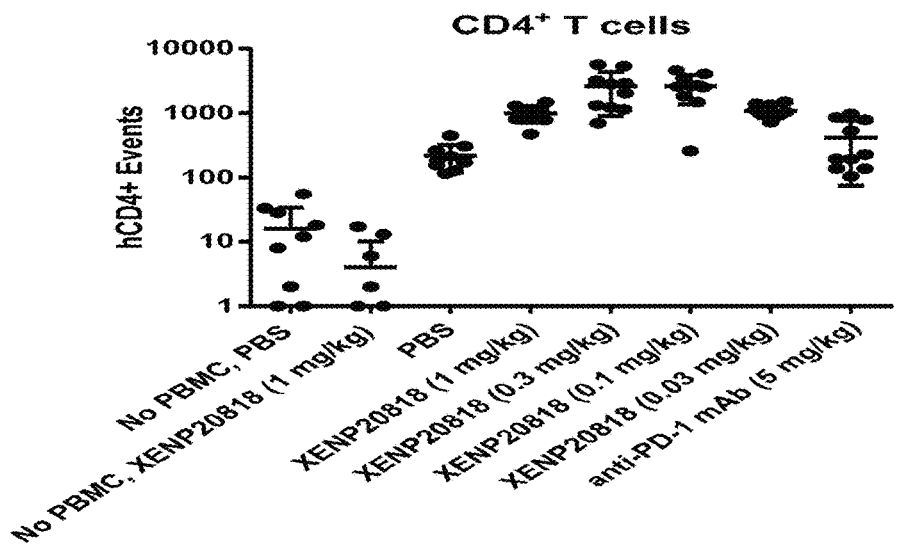
Figure 25B:
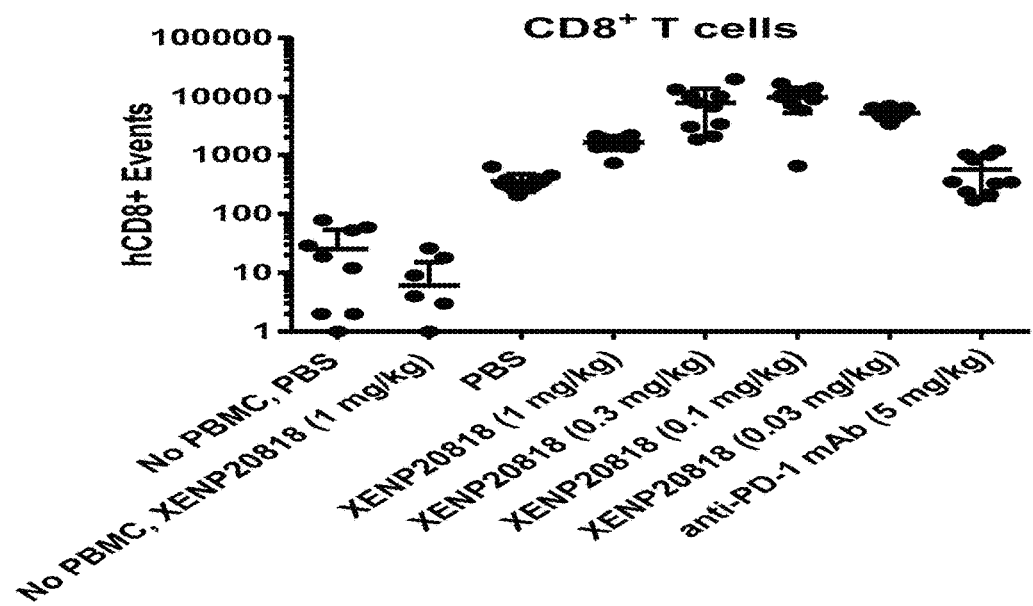
Figure 25C:
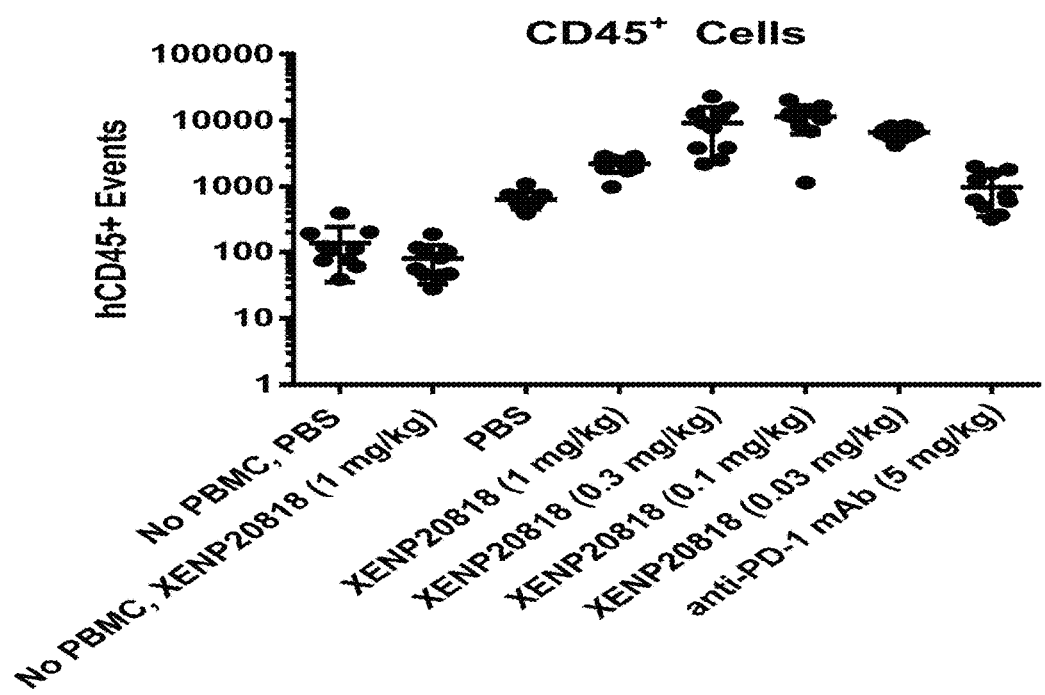

FIGS. 25A-25C depict A) CD4+ T cell, B) CD8+ T cell, and C) CD45+ cell counts in whole blood of human PBMC-engrafted NSG mice 7 days after treatment with XENP20818 at the indicated concentrations.

Figure 26:
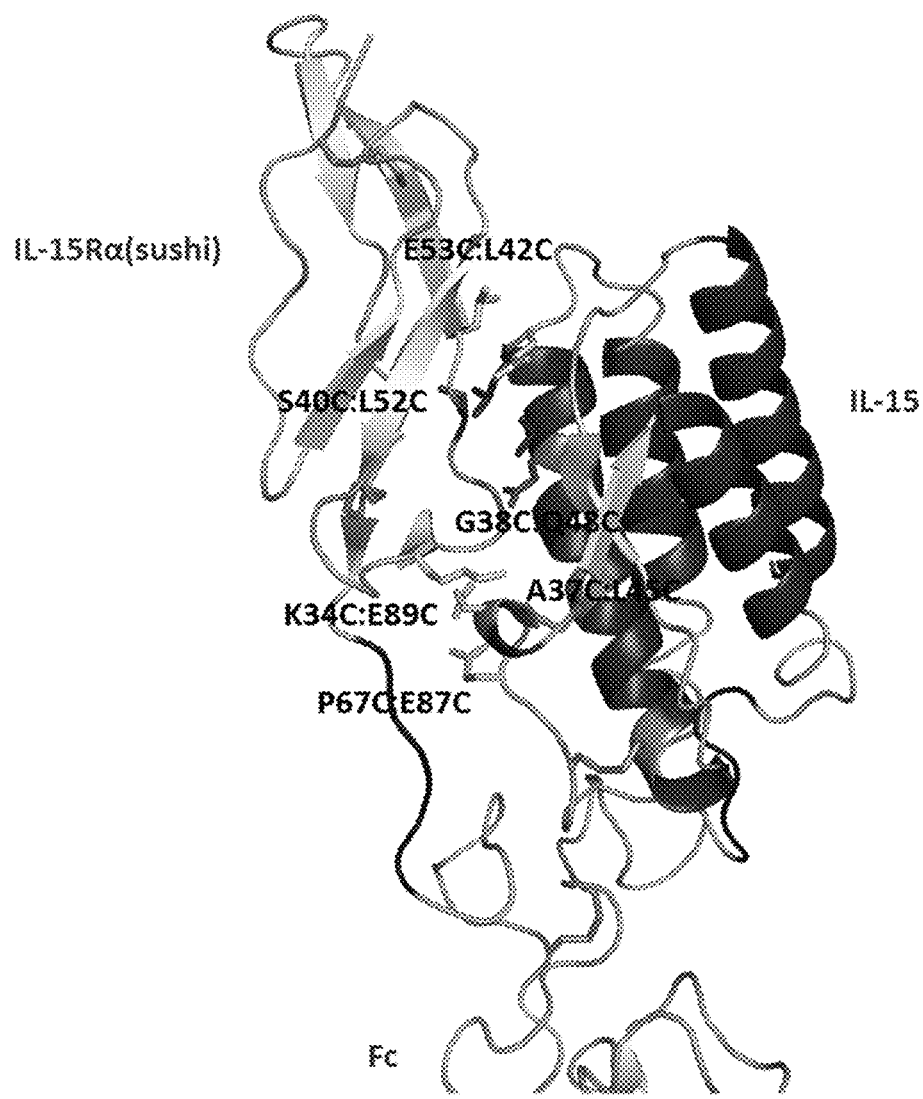

FIG. 26 depicts a structural model of the IL-15/Rα heterodimer showing locations of engineered disulfide bond pairs.

FIG. 27 depicts sequences for illustrative IL-15Rα(sushi) variants engineered with additional residues at the C-terminus to serve as a scaffold for engineering cysteine residues.

FIG. 28 depicts sequences for illustrative IL-15 variants engineered with cysteines in order to form covalent disulfide bonds with IL-15Rα(sushi) variants engineered with cysteines.

FIG. 29 depicts sequences for illustrative IL-15Rα(sushi) variants engineered with cysteines in order to form covalent disulfide bonds with IL-15 variants engineered with cysteines.

Figure 30A:
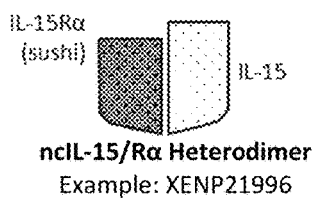
Figure 30B:
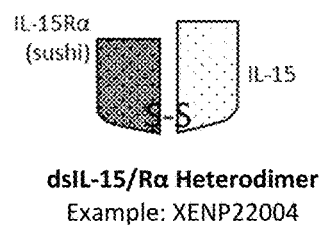
Figure 30C:
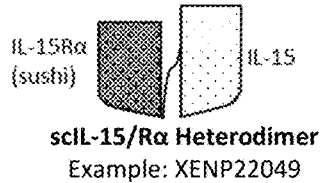

FIGS. 30A-30C depict IL-15/Rα heterodimers with and without engineered disulfide bonds between IL-15 and IL-15Rα(sushi). Non-covalent IL-15/Rα heterodimer or "ncIL-15/Rα heterodimer" (FIG. 30A) comprises IL-15Rα (sushi) and IL-15 transfected separately and non-covalently linked. Disulfide-bonded IL-15/Rα heterodimer or "dsIL-15/Rα heterodimer" (FIG. 30B) comprises IL-15Rα(sushi) and IL-15 transfected separately and covalently linked as a result of engineered cysteines. Single-chain IL-15/Rα heterodimer or "scIL-15/Rα Heterodimer" (FIG. 30C) comprises IL-15Rα(sushi) fused to IL-15 by a variable length Gly-Ser linker.

FIG. 31 depicts sequences of XENP21996, an illustrative ncIL-15/Rα heterodimer. It is important to note that these sequences were generated using polyhistidine (His×6 or HHHHHH (SEQ ID NO: 1198)) C-terminal tags at the C-terminus of IL-15Rα(sushi).

FIG. 32 depicts sequences of XENP22004, XENP22005, XENP22006, XENP22008, and XENP22494, illustrative dsIL-15/Rα heterodimers, with additional sequences depicted as XENPs 22007, 22009, 22010, 22011, 22012, and 22493 in the sequence listing. It is important to note that these sequences were generated using polyhistidine (His×6 or HHHHHH (SEQ ID NO: 1198)) C-terminal tags at the C-terminus of IL-15Rα(sushi).

Figure 34:
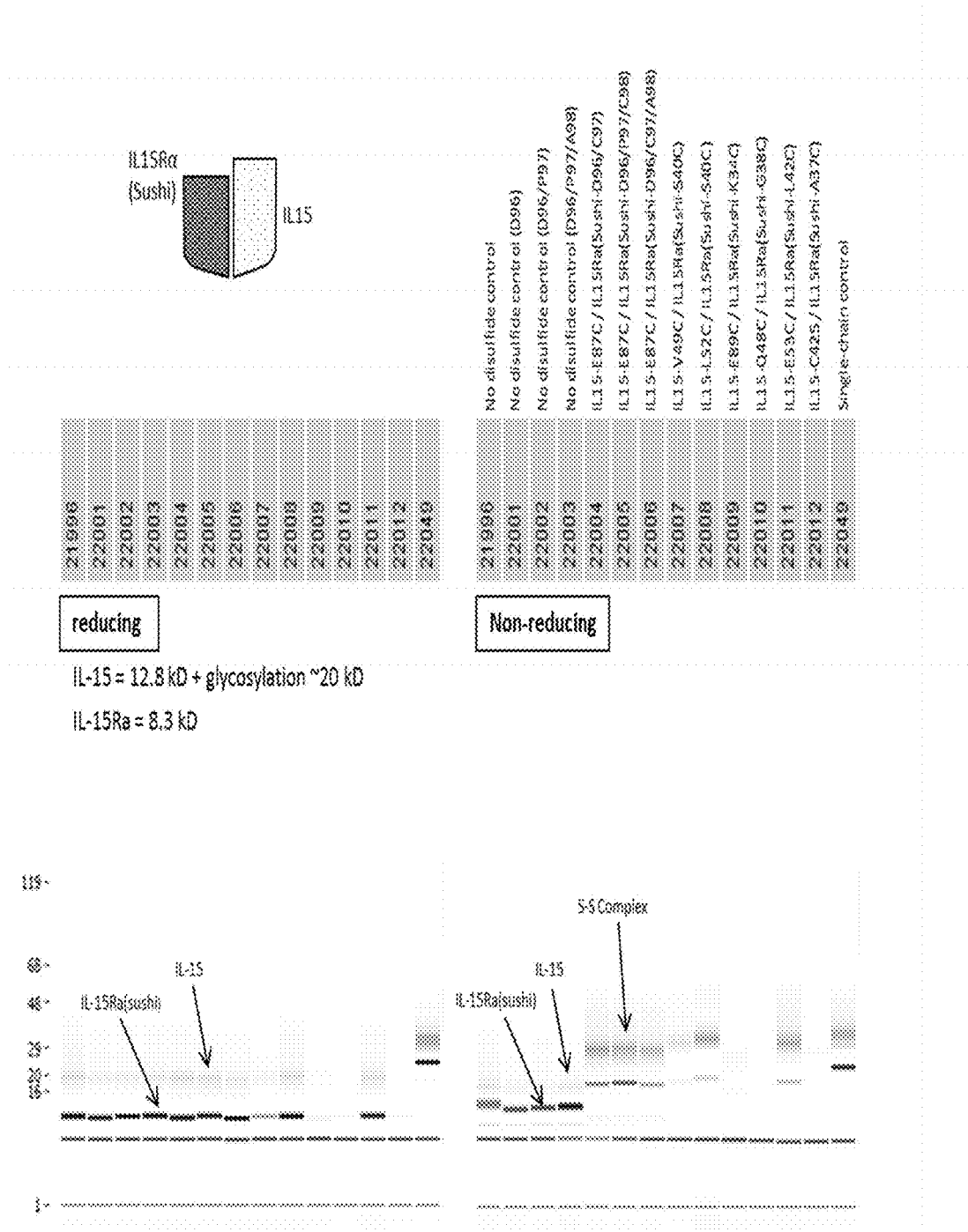

FIG. 33 depicts the sequence for XENP22049, an illustrative scIL-15/Rα Heterodimer. It is important to note that these sequences were generated using polyhistidine (His×6 or HHHHHH (SEQ ID NO: 1198)) C-terminal tags at the C-terminus of IL-15. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, and linker FIG. 34 depicts the purity and homogeneity of illustrative IL-15/Rα heterodimers with and without engineered disulfide bonds as determined by CEF.

Figure 35:
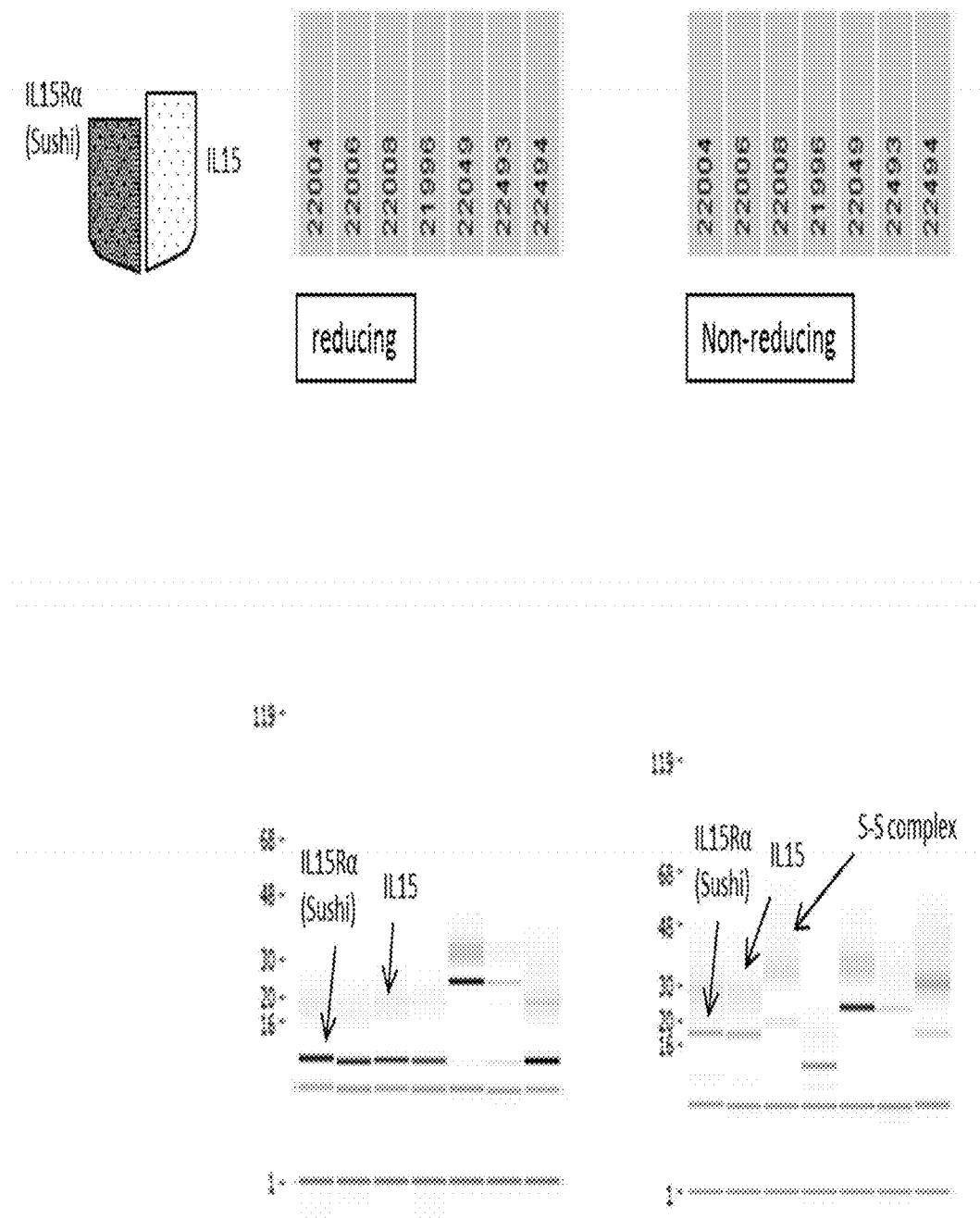

FIG. 35 depicts the purity and homogeneity of illustrative IL-15/Rα heterodimers with and without engineered disulfide bonds as determined by CEF.

Figure 36:
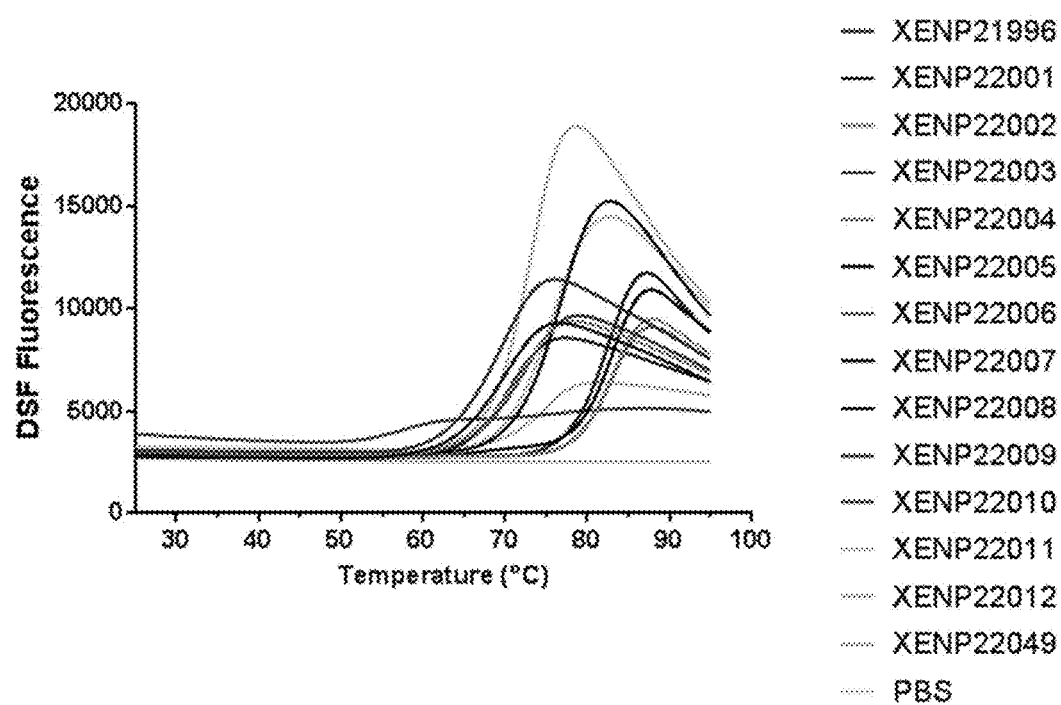

FIG. 36 depicts the stability and melting temperatures of illustrative IL-15/Rα heterodimers with and without engineered disulfide bonds as indicated by melting curves from DSF.

Figure 37:
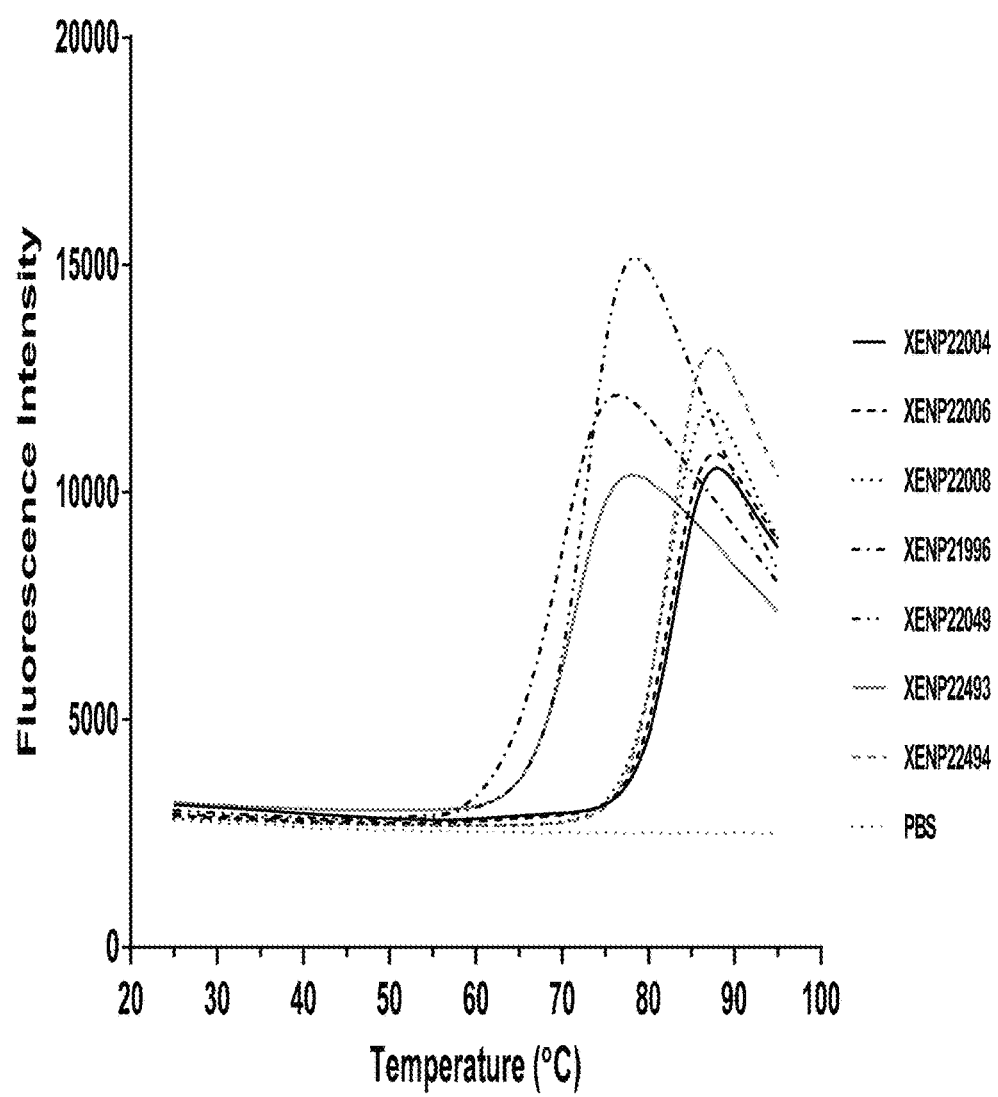
Figure 39A:
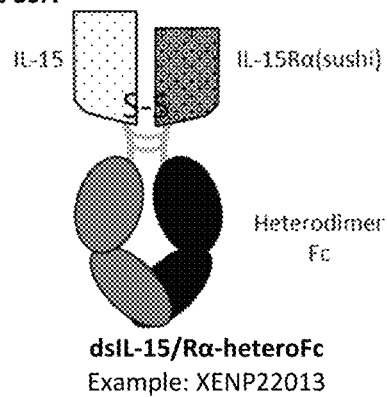
Figure 39B:
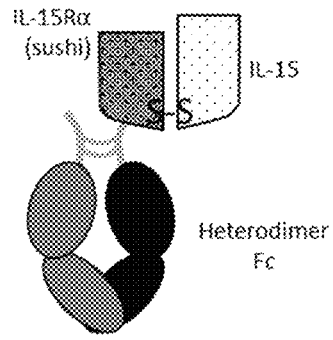
Figure 39C:
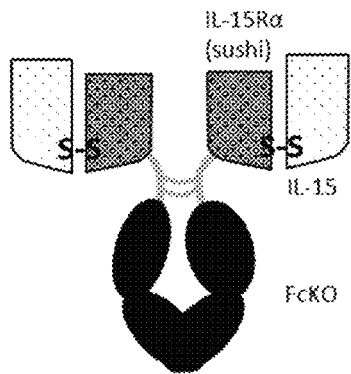
Figure 39D:
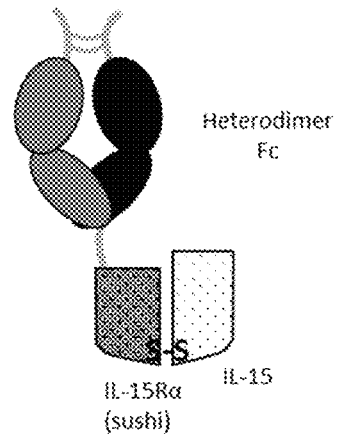

FIG. 37 depicts the stability and melting temperatures of illustrative IL-15/Rα heterodimers with and without engineered disulfide bonds as indicated by melting curves from DSF.

FIG. 38 depicts the expression yield, molecular weight, predicted change in affinity between IL-15 and IL-15Rα (sushi) as calculated by MOE software, melting temperature, and affinity for IL-2Rβ for IL-15/Rα heterodimers with and without engineered disulfide bonds. Mutations are indicated in parentheses after the relevant monomer.

FIGS. 39A-39D depict additional formats for the IL-15/Rα-Fc fusion proteins of the present invention with engineered disulfide bonds. Disulfide-bonded IL-15/Rα heterodimeric Fc fusion or "dsIL-15/Rα-heteroFc" (FIG. 39A) is the same as "IL-15/Rα-heteroFc", but wherein IL-15Rα (sushi) and IL-15 are further covalently linked as a result of engineered cysteines. Disulfide-bonded IL-15/Rα Fc fusion or "dsIL-15/Rα-Fc" (FIG. 39B) is the same as "ncIL-15/Rα-Fc", but wherein IL-15Rα(sushi) and IL-15 are further covalently linked as a result of engineered cysteines. Bivalent disulfide-bonded IL-15/Rα-Fc or "bivalent dsIL-15/Rα-Fc" (FIG. 39C) is the same as "bivalent ncIL-15/Rα-Fc", but wherein IL-15Rα(sushi) and IL-15 are further covalently linked as a result of engineered cysteines. Fc-disulfide-bonded IL-15/Rα fusion or "Fc-dsIL-15/Rα" (FIG. 39D) is the same as "Fc-ncIL-15/Rα", but wherein IL-15Rα(sushi) and IL-15 are further covalently linked as a result of engineered cysteines.

FIGS. 40A-40B depicts sequences of XENP22013, XENP22014, XENP22015, and XENP22017, illustrative IL-15/Rα-Fc fusion protein of the "dsIL-15/Rα-heteroFc" format. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIGS. 41A-41B depict sequences of XENP22357, XENP22358, XENP22359, XENP22684, and XENP22361, illustrative IL-15/Rα-Fc fusion proteins of the "dsIL-15/Rα-Fc" format. Additional sequences are depicted as XENPs 22360, 22362, 22363, 22364, 22365, and 22366 in the sequence listing. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIG. 42 depicts sequences of XENP22634, XENP22635, and XENP22636, illustrative IL-15/Rα-Fc fusion proteins of the "bivalent dsIL-15/Rα-Fc" format. Additional sequences are depicted as XENP22687 in the sequence listing. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIG. 43 depicts sequences of XENP22639 and XENP22640, illustrative IL-15/Rα-Fc fusion proteins of the "Fc-dsIL-15/Rα" format. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

Figure 44:
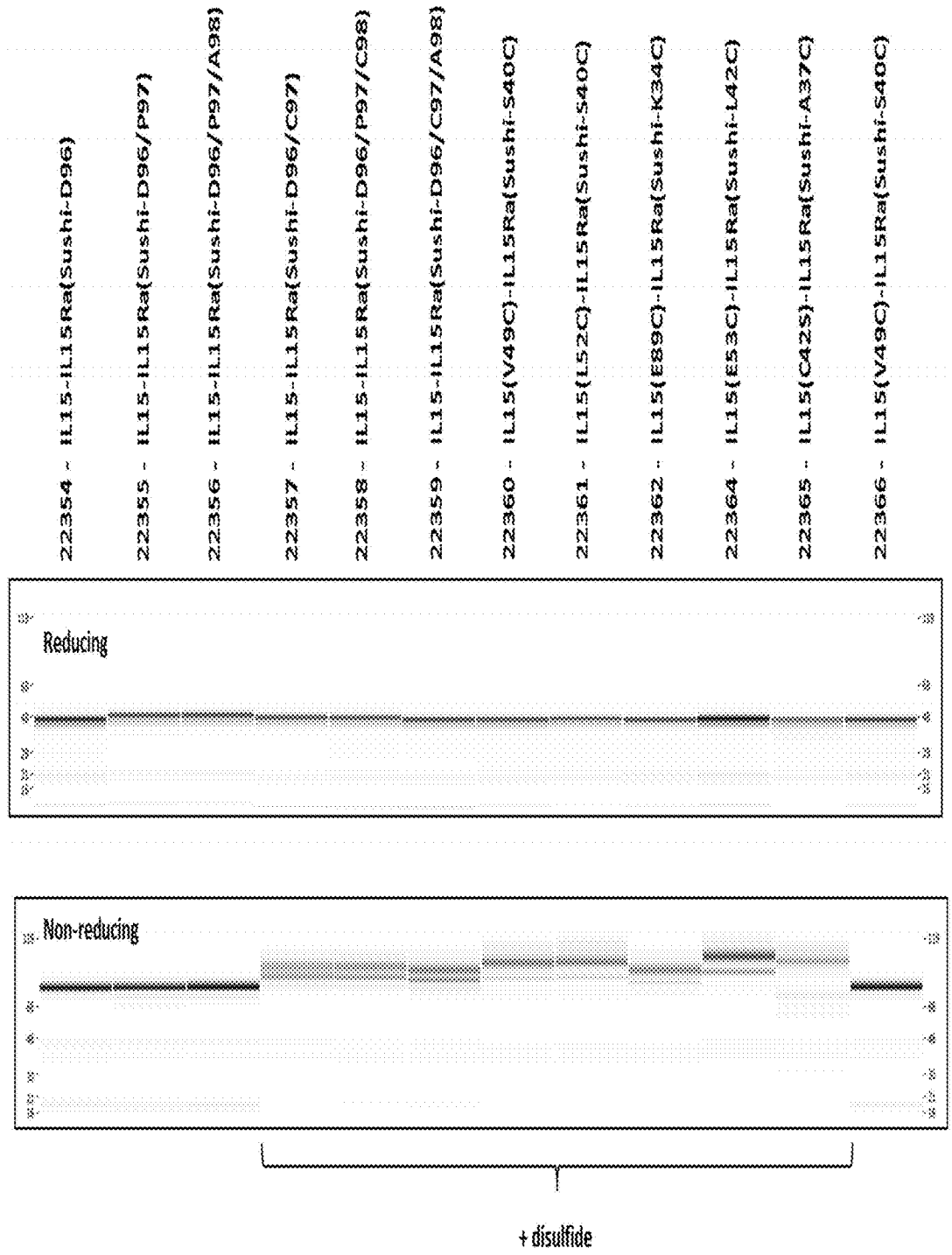

FIG. 44 depicts the purity and homogeneity of illustrative IL-15/Rα-Fc fusion proteins with and without engineered disulfide bonds as determined by CEF.

Figure 45A:
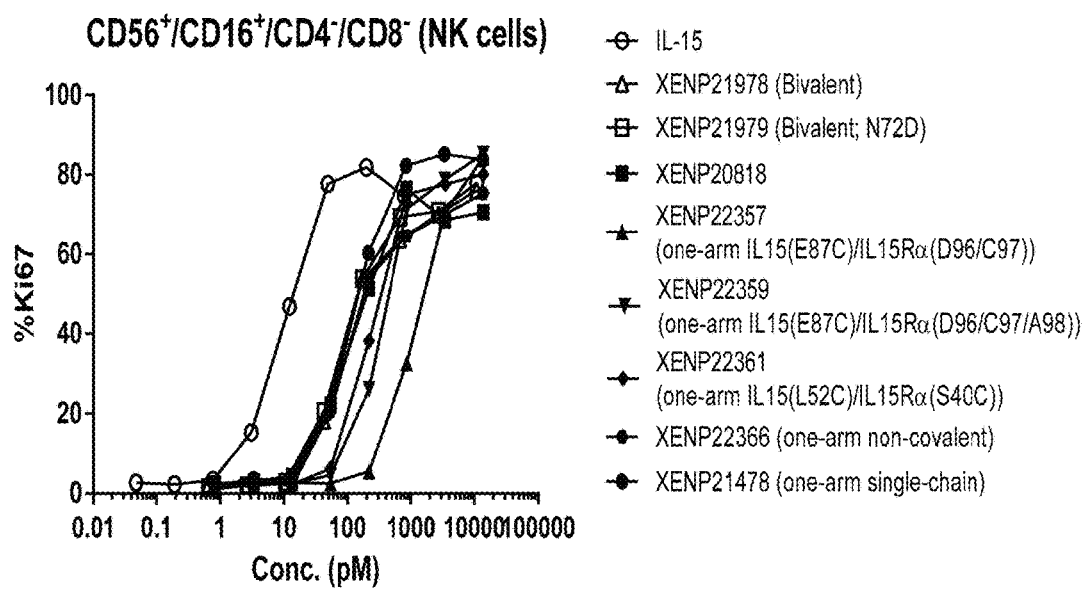
Figure 45B:
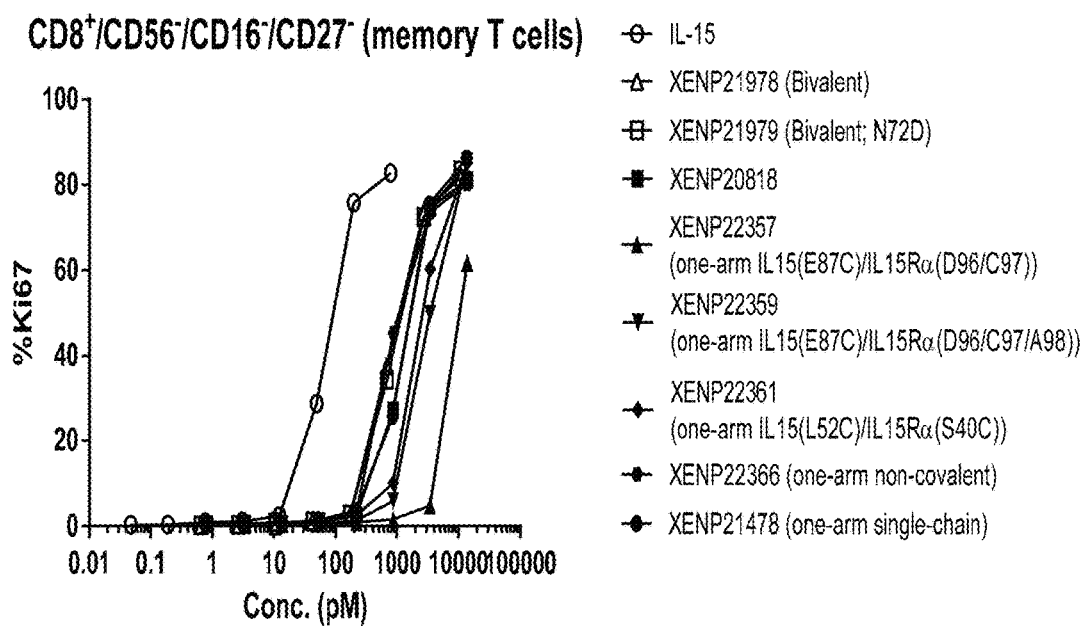
Figure 45C:
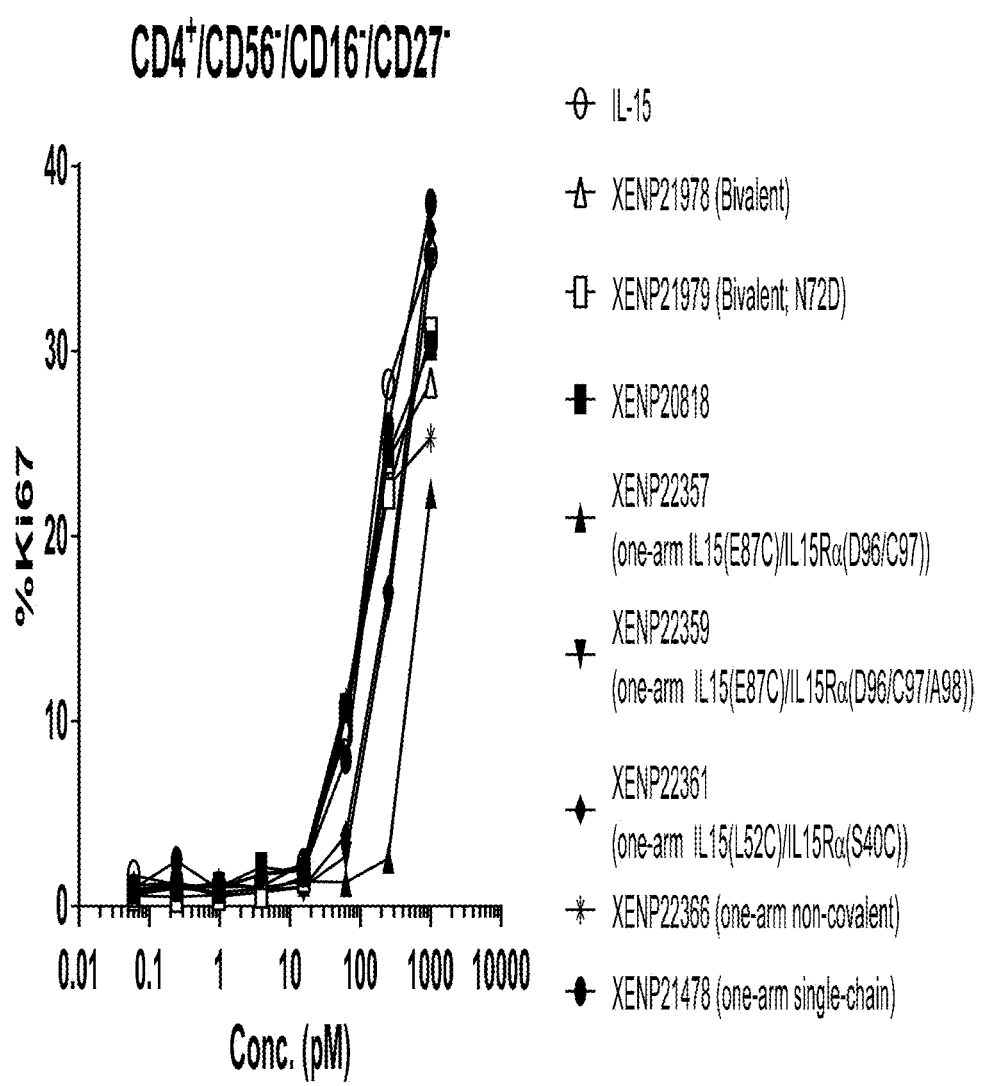

FIGS. 45A-45C depict the induction of A) NK (CD56+/CD16+) cell, B) CD8+ T cell, and C) CD4+ T cell proliferation by illustrative IL-15/Rα-Fc fusion proteins with and without engineered disulfide bonds based on Ki67 expression as measured by FACS.

Figure 46:
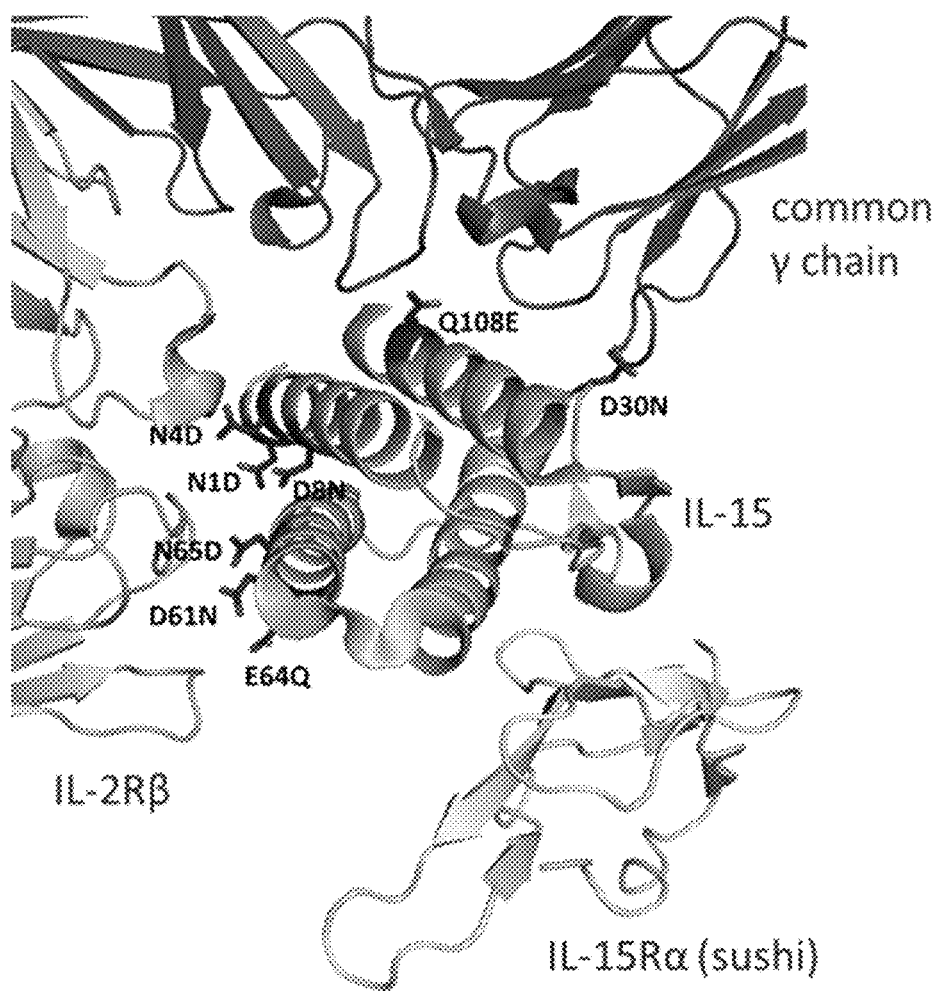

FIG. 46 depicts the structure of IL-15 complexed with IL-15Rα, IL-2Rß, and common gamma chain. Locations of substitutions designed to reduce potency are shown.

FIGS. 47A-47C depict sequences for illustrative IL-15 variants engineered for reduced potency. Included within each of these variant IL-15 sequences are sequences that are 90%, 95%, 98%, and 99% identical (as defined herein) to the recited sequences, and/or contain from 1, 2, 3, 4, 5, 6, 7, 8, 9 or 10 additional amino acid substitutions. In a non-limiting example, the recited sequences may contain additional amino acid modifications such as those contributing to formation of covalent disulfide bonds as described in Example 2.

FIGS. 48A-48D depict sequences of XENP22821, XENP22822, XENP23554, XENP23557, XENP23561, XENP24018, XENP24019, XENP24045, XENP24051, and XENP24052, illustrative IL-15/Rα-Fc fusion proteins of the "IL-15/Rα-heteroFc" format engineered for lower potency. Additional sequences are depicted as XENPs 22815, 22816, 22817, 22818, 22819, 22820, 22823, 22824, 22825, 22826, 22827, 22828, 22829, 22830, 22831, 22832, 22833, 22834, 23555, 23559, 23560, 24017, 24020, 24043, and 24048 in the sequence listing. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIGS. 49A-49C depict sequences of XENP24015, XENP24050, XENP24475, XENP24476, XENP24478, XENP24479, and XENP24481, illustrative IL-15/Rα-Fc fusion proteins of the "scIL-15/Rα-Fc" format engineered for lower potency. Additional sequences are depicted as XENPs 24013, 24014, and 24016 in the sequence listing. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIGS. 50A-50B depict sequences of XENP24349, XENP24890, and XENP25138, illustrative IL-15/Rα-Fc fusion proteins of the "ncIL-15/Rα-Fc" format engineered for lower potency. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIG. 51 depicts sequences of XENP22801 and XENP22802, illustrative ncIL-15/Rα heterodimers engineered for lower potency. Additional sequences are depicted as XENPs 22791, 22792, 22793, 22794, 22795, 22796, 22803, 22804, 22805, 22806, 22807, 22808, 22809, 22810, 22811, 22812, 22813, and 22814 in the sequence listing. It is important to note that these sequences were generated using polyhistidine (His×6 or HHHHHH (SEQ ID NO: 1198)) C-terminal tags at the C-terminus of IL-15Rα(sushi).

FIG. 52 depicts sequences of XENP24342, an illustrative IL-15/Rα-Fc fusion protein of the "bivalent ncIL-15/Rα-Fc" format engineered for lower potency. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIG. 53 depicts sequences of XENP23472 and XENP23473, illustrative IL-15/Rα-Fc fusion proteins of the "dsIL-15/Rα-Fc" format engineered for lower potency. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIGS. 54A-54C depict the induction of (A) NK cell, (B) CD8+ (CD45RA−) T cell, and (C) CD4+ (CD45RA−) T cell proliferation by variant IL-15/Rα-Fc fusion proteins based on Ki67 expression as measured by FACS.

FIG. 55 depicts EC50 for induction of NK and CD8+ T cells proliferation by variant IL-15/Rα-Fc fusion proteins, and fold reduction in EC50 relative to XENP20818.

FIGS. 56A-56C depict the gating of lymphocytes and subpopulations for the experiments depicted in FIGS. 59A-59D. FIG. 56A shows the gated lymphocyte population. FIG. 56B shows the CD3-negative and CD3-positive subpopulations. FIG. 56C shows the CD16=negative and CD16-positive subpopulations of the CD3-negative cells.

FIGS. 57A-57C depict the gating of CD3+ lymphocyte subpopulations for the experiments depicted in FIGS. 59A-59D. FIG. 57A shows the CD4+, CD8+ and γδ T cell subpopulations of the CD3+ T cells. FIG. 57B shows the CD45RA(−) and CD45RA(+) subpopulations of the CD4+ T cells. FIG. 57C shows the CD45RA(−) and CD45RA(+) subpopulation s of the CD8+ T cells.

FIGS. 58A-58B depict CD69 and CD25 expression before (FIG. 58A) and after (FIG. 58B) incubation of human PBMCs with XENP22821.

FIGS. 59A-59D depict cell proliferation in human PBMCs incubated for four days with the indicated variant IL-15/Rα-Fc fusion proteins. FIGS. 59A-C show the percentage of proliferating NK cells (CD3-CD16+) (FIG. 59A), CD8+ T cells (CD3+CD8+CD45RA−) (FIG. 59B) and CD4+ T cells (CD3+CD4+CD45RA−) (FIG. 59C). FIG. 59D shows the fold change in EC50 of various IL15/IL15Rα Fc heterodimers relative to control (XENP20818).

FIGS. 60A-60D depict cell proliferation in human PBMCs incubated for three days with the indicated variant IL-15/Rα-Fc fusion proteins. FIGS. 60A-C show the percentage of proliferating CD8+ (CD45RA−) T cells (Figure A), CD4+ (CD45RA−) T cells (FIG. 60B), γδ T cells (FIG. 60C), and NK cells (FIG. 60D).

FIGS. 61A-61C depict the percentage of Ki67 expression on (A) CD8+ T cells, (B) CD4+ T cells, and (C) NK cells following treatment with additional IL-15/Rα variants.

FIGS. 62A-62E depict the percentage of Ki67 expression on (A) CD8+ (CD45RA−) T cells, (B) CD4+ (CD45RA−) T cells, (C) γδ T cells, (D) NK (CD16+CD8α–) cells, and (E) NK (CD56+CD8a–) cells following treatment with IL-15/Rα variants.

FIGS. 63A-63E depict the percentage of Ki67 expression on (A) CD8+ (CD45RA–) T cells, (B) CD4+ (CD45RA–) T cells, (C) γδ T cells, (D) NK (CD16+CD8a–) cells, and (E) NK (CD56+CD8a–) cells following treatment with IL-15/Rα variants.

FIGS. 64A-64D depict the percentage of Ki67 expression on (A) CD8+ T cells, (B) CD4+ T cells, (C) γδ T cells and (D) NK (CD16+) cells following treatment with additional IL-15/Rα variants engineered for decreased potency with different linker lengths.

FIGS. 65A-65D depict the percentage of Ki67 expression on (A) CD8+ T cells, (B) CD4+ T cells, (C) γδ T cells and (D) NK (CD16+) cells following treatment with additional IL-15/Rα variants.

Figure 66A:
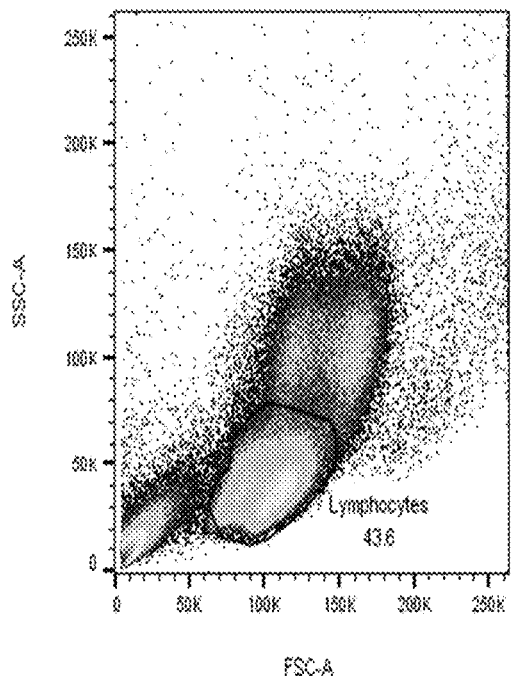
Figure 66B:
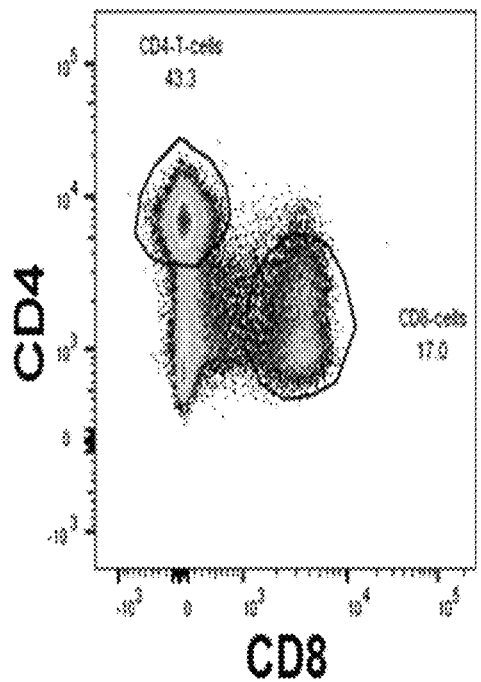
Figure 66C:
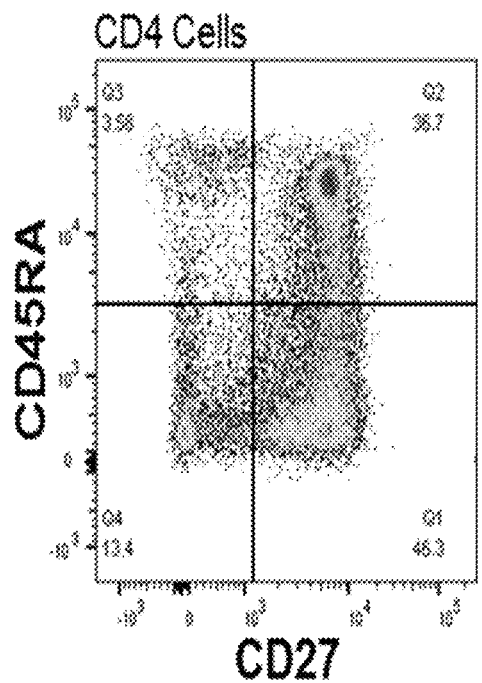
Figure 66D:
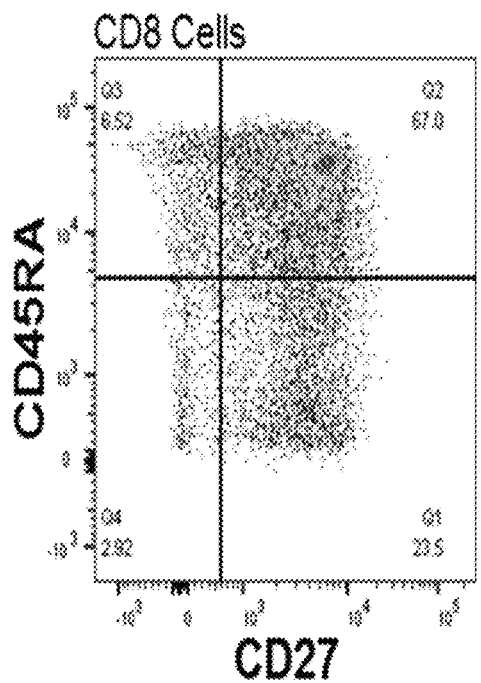

FIGS. 66A-66D depict gating of lymphocytes and subpopulations thereof for the experiments depicted in FIG. 67. FIG. 66A shows gating of the lymphocyte population. FIG. 66B shows CD4+ and CD8+ T cells. FIG. 66C shows the CD45RA and CD27 expressing subpopulations of CD4+ T cells. FIG. 66D shows the CD45RA and CD27 expressing subpopulations of CD8+ T cells.

Figure 67A:
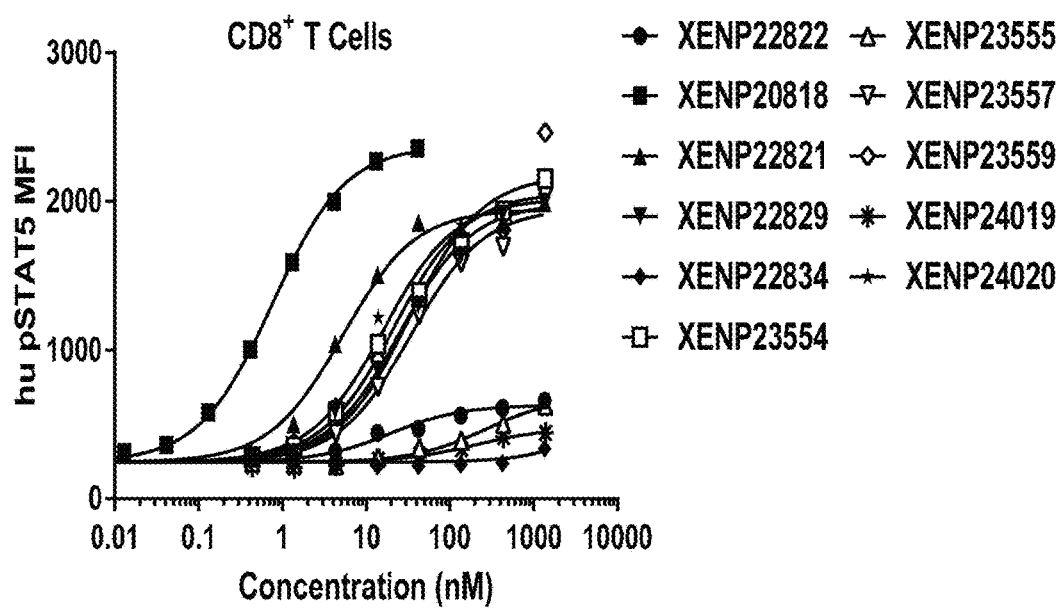
Figure 67B:
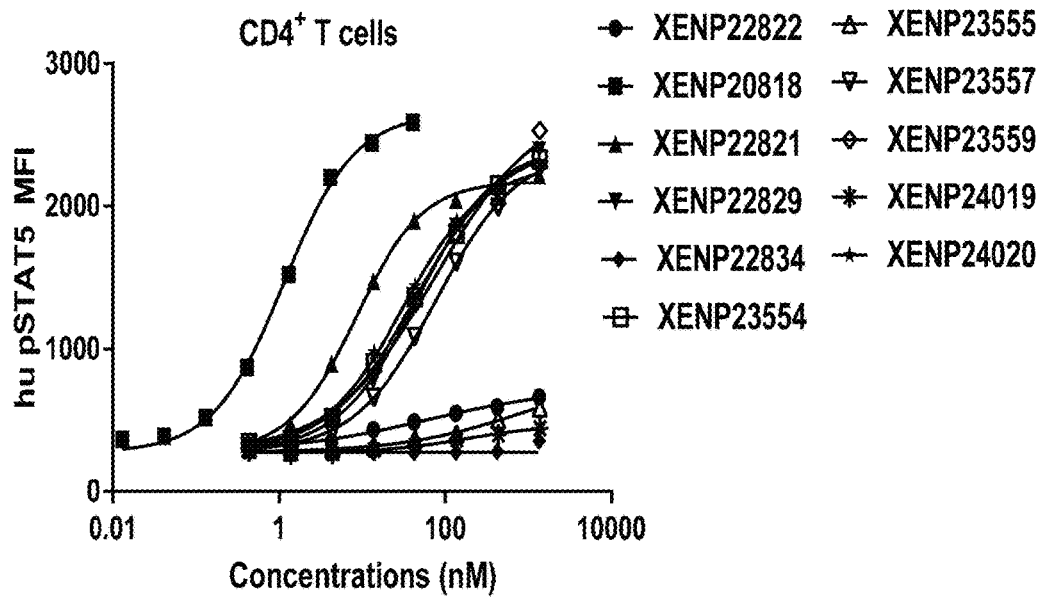

FIGS. 67A-67C depict STAT5 phosphorylation on A) CD8+ T cells (CD45RA-CD27–) and B) CD4+ T cells (CD45RA-CD27–) following incubation of PBMCs for 4 days with the indicated variant IL15/IL15Rα-Fc fusion proteins at the indicated concentrations. FIG. 67C shows the fold change in EC50 of various IL15/IL15Rα Fc heterodimers relative to control (XENP20818).

Figure 68:
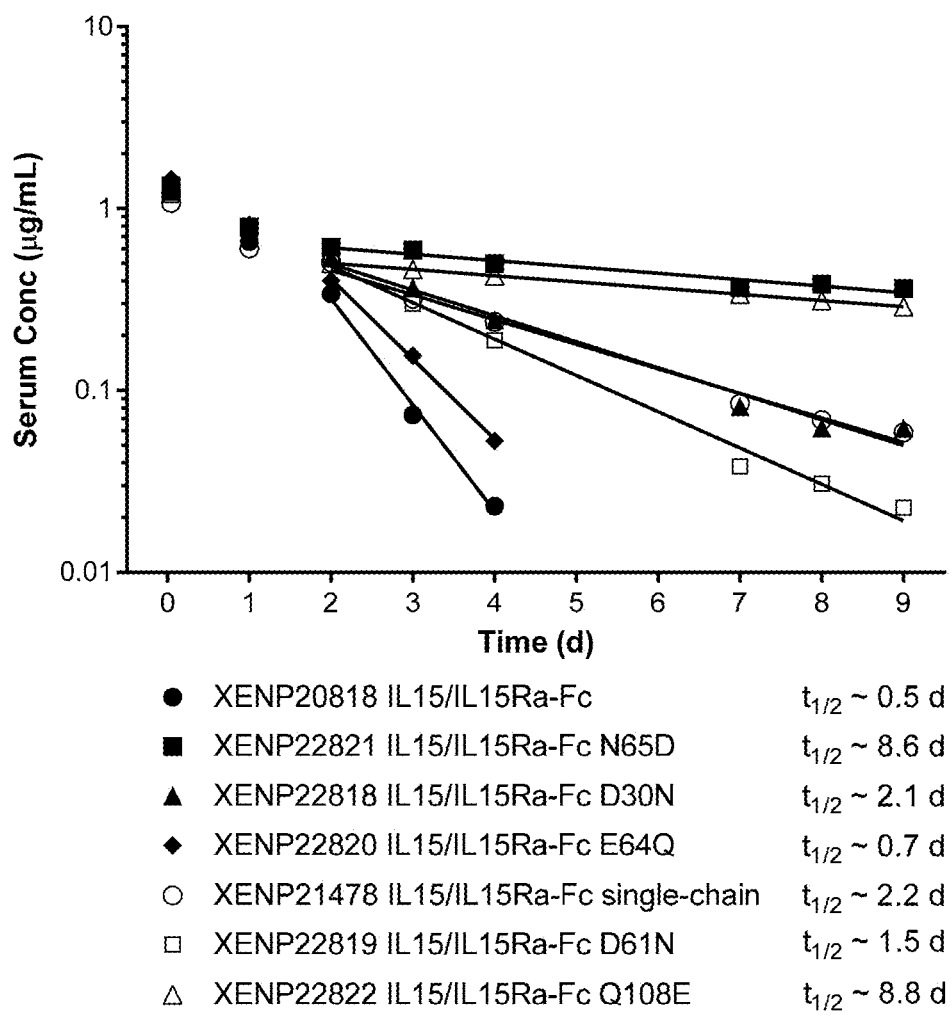

FIG. 68 depicts IV-TV Dose PK of various IL-15/Rα-Fc fusion proteins or controls in C57BL/6 mice at 0.1 mg/kg single dose.

Figure 69:
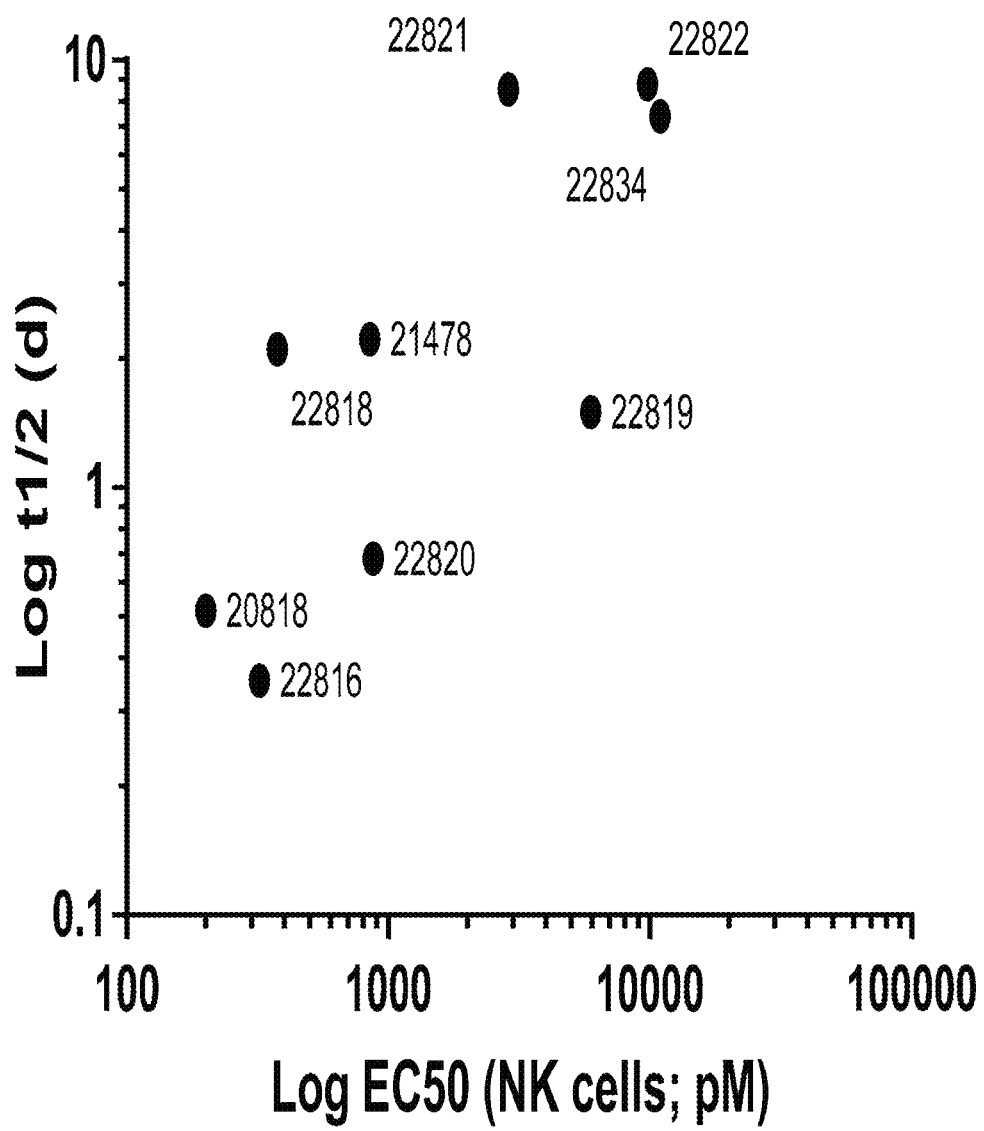

FIG. 69 depicts the correlation of half-life vs NK cell potency.

Figure 70:
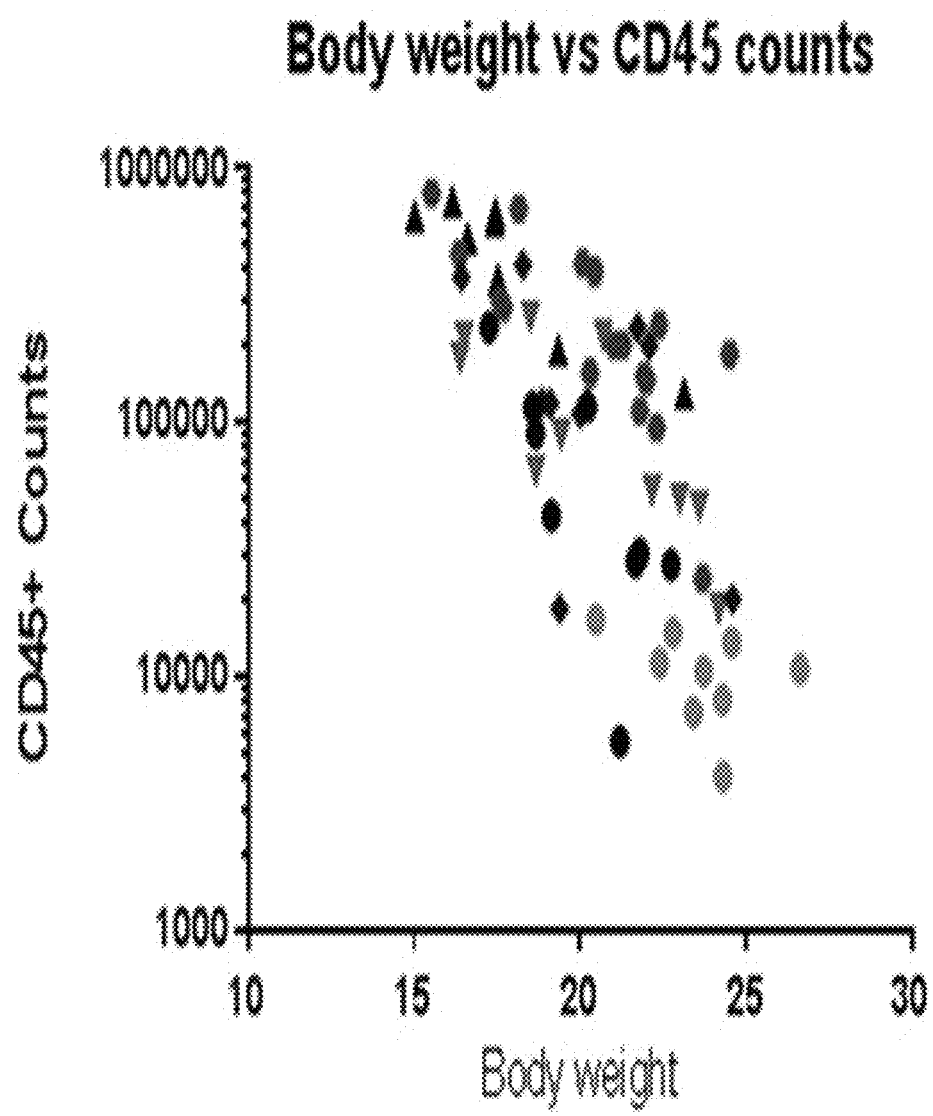

FIG. 70 shows that CD45+ cell levels are predictive of disease.

Figure 71A:
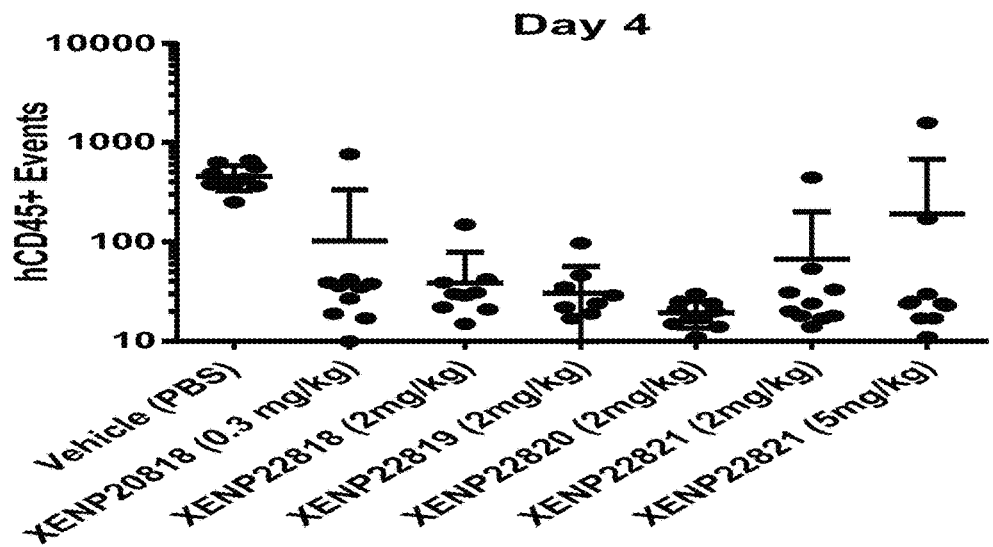
Figure 71B:
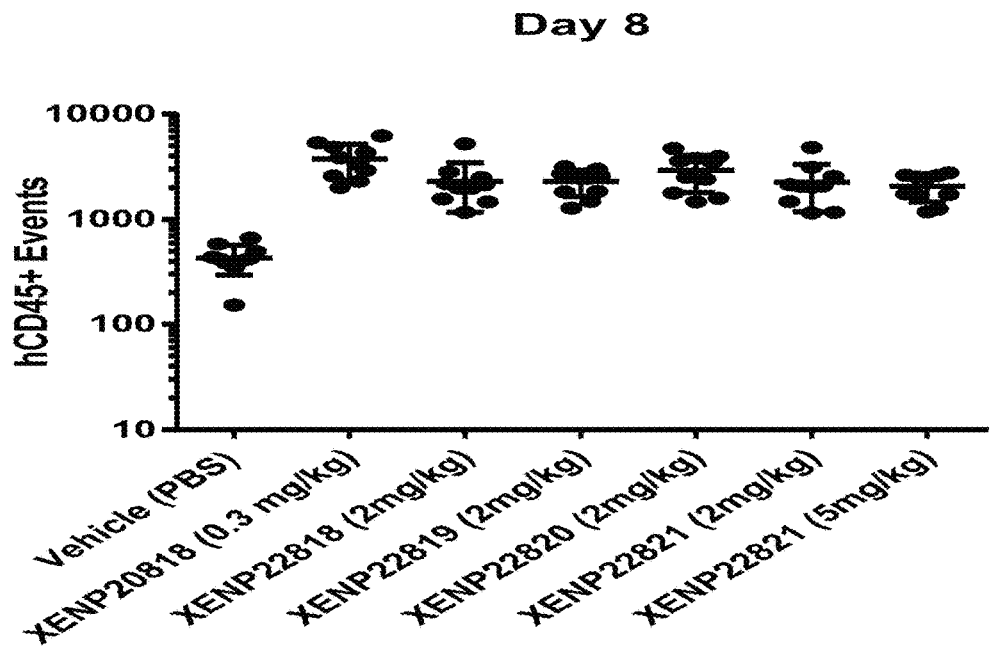

FIGS. 71A-71B depict the enhancement of engraftment by variant IL-15/Rα-Fc fusion proteins as indicated by CD45+ cell counts on Days A) 4 and B) 8.

Figure 72A:
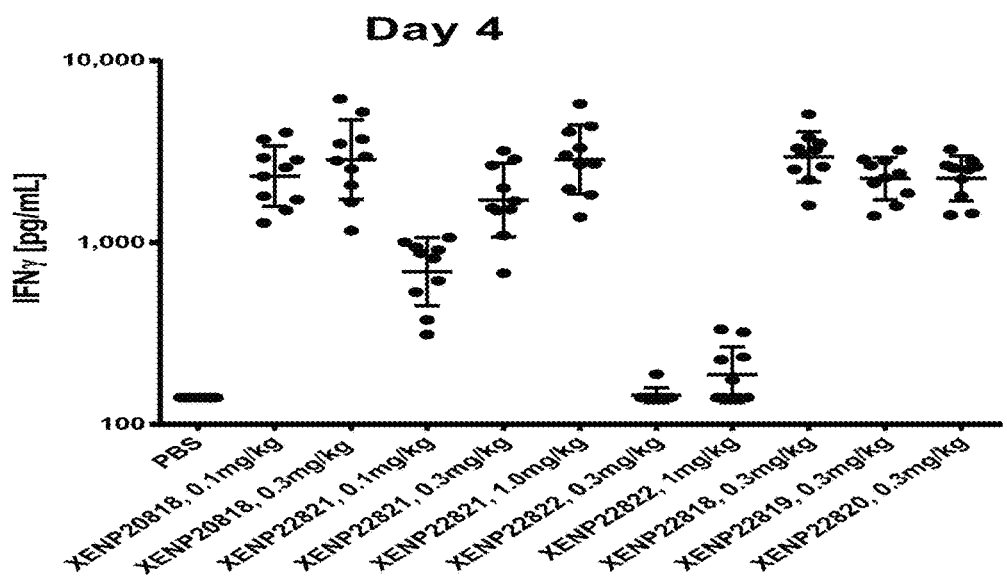
Figure 72B:
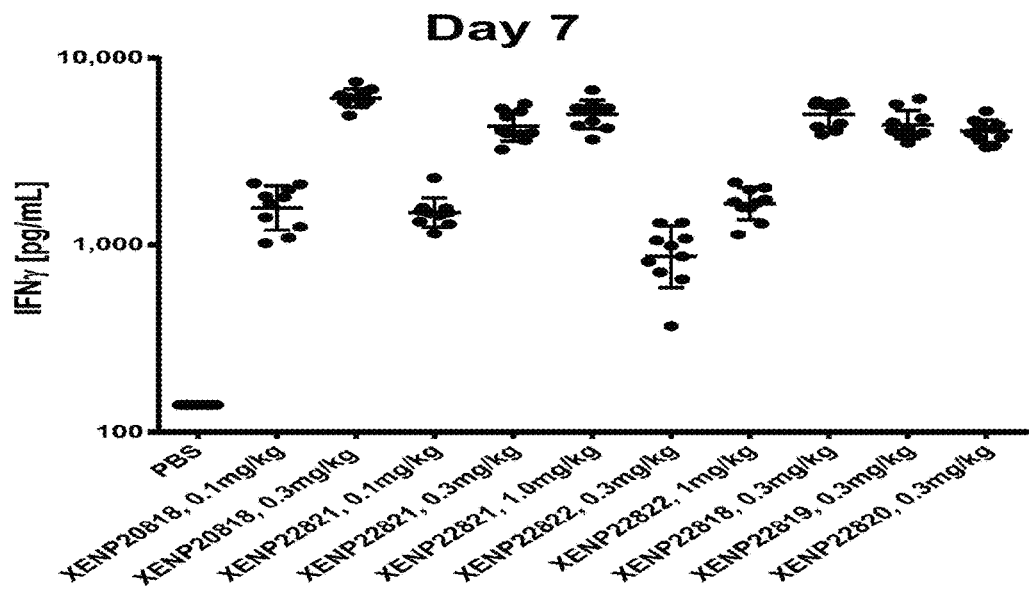
Figure 72C:
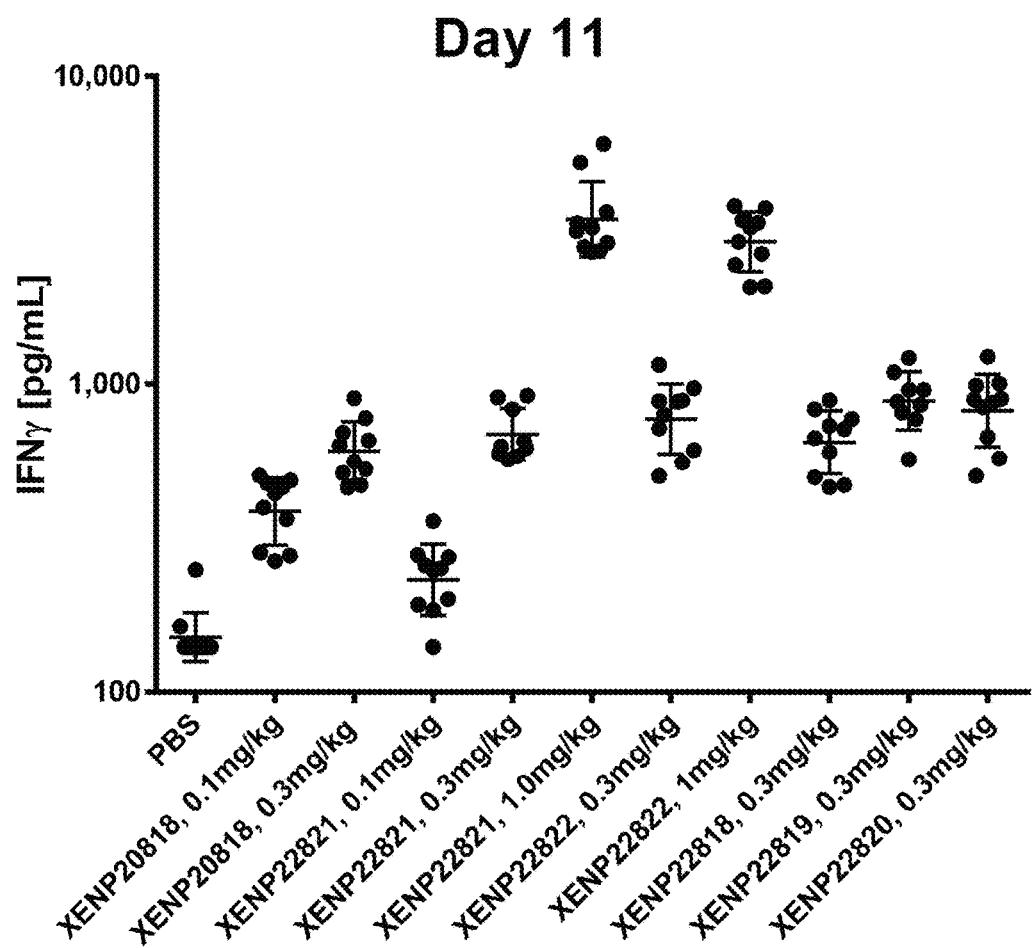

FIGS. 72A-72C depict IFNγ levels on Days (A) 4, (B) 7 and (C) 11 after treatment of NSG mice engrafted with human PBMCs with the indicated variant IL15/Rα-Fc fusion proteins or control.

Figure 73A:
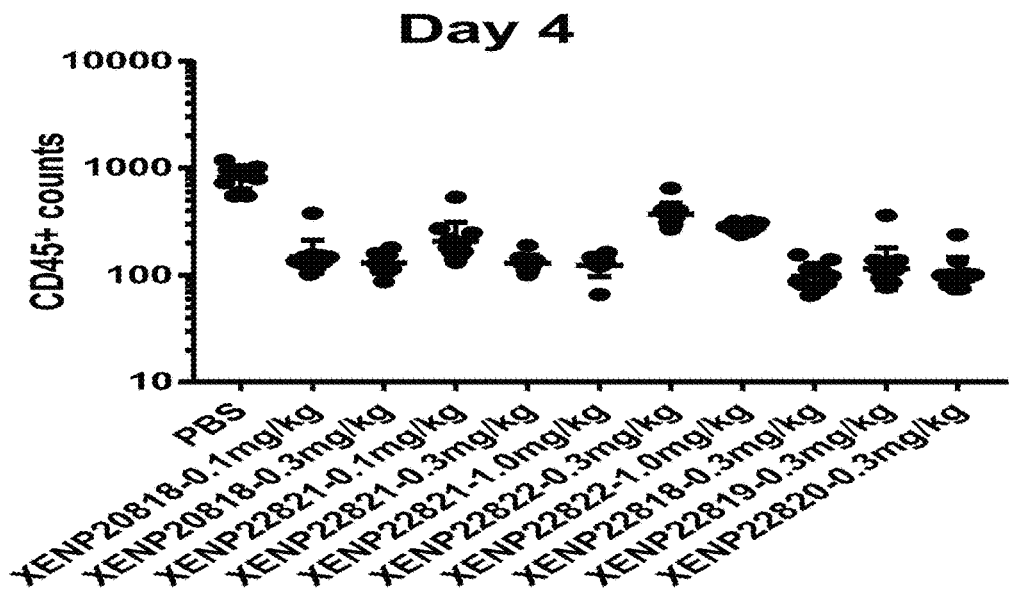
Figure 73B:
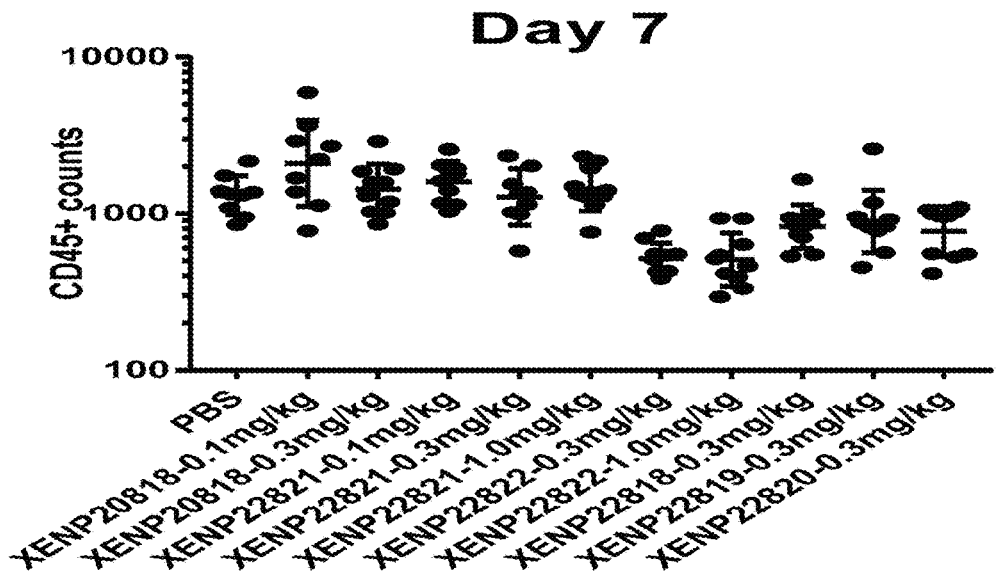
Figure 73C:
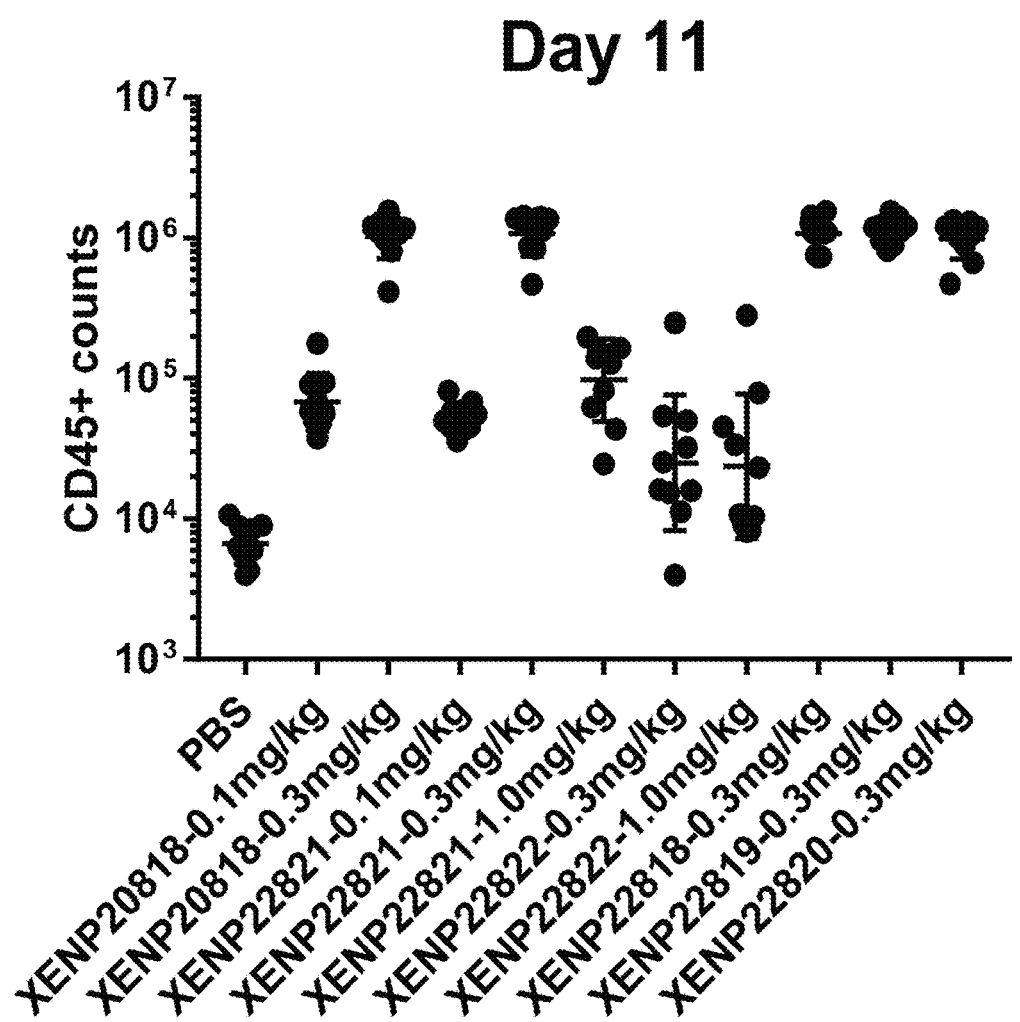

FIGS. 73A-73C depict CD45+ lymphocyte cell counts on Days (A) 4, (B) 7, and (C) 11 after treatment of NSG mice engrafted with human PBMCs with the indicated variant IL15/Rα-Fc fusion proteins or control.

Figure 74A:
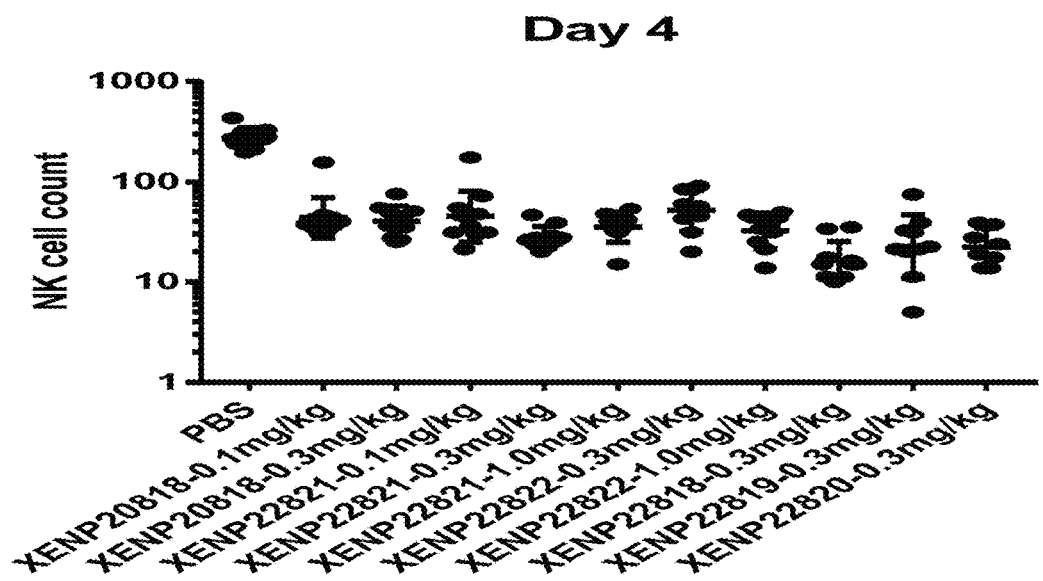
Figure 74B:
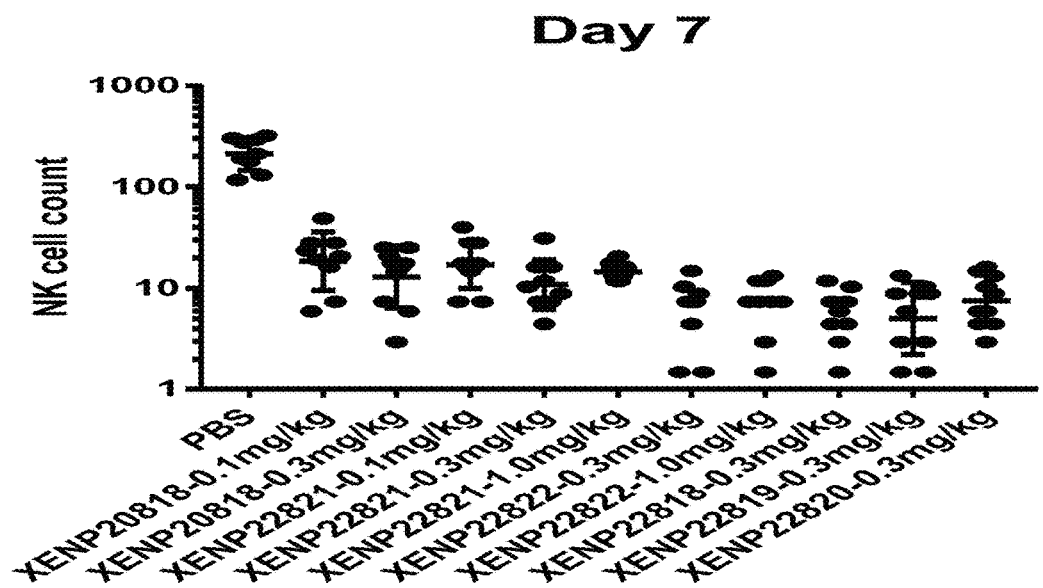
Figure 74C:
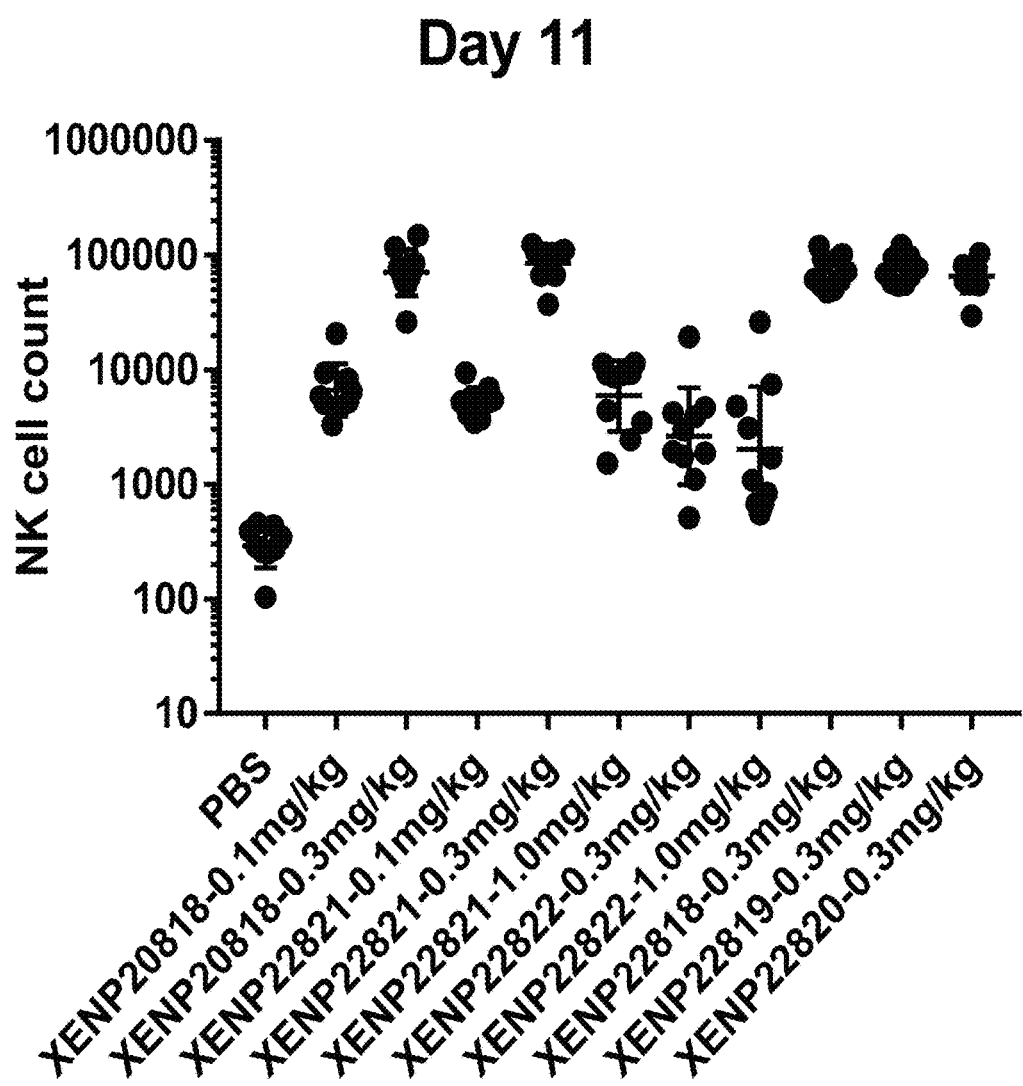

FIGS. 74A-74C depict NK cell (CD16+CD56+CD45RA+) counts on Days A) 4, B) 7 and C) 11 after treatment of NSG mice engrafted with human PBMCs with the indicated IL15/Rα-Fc fusion proteins or control.

Figure 75A:
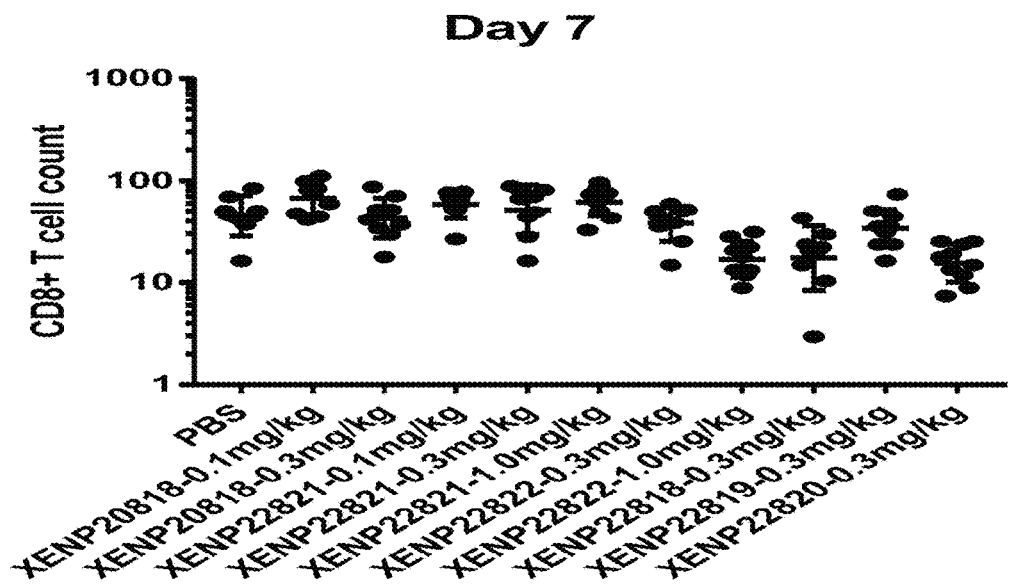
Figure 75B:
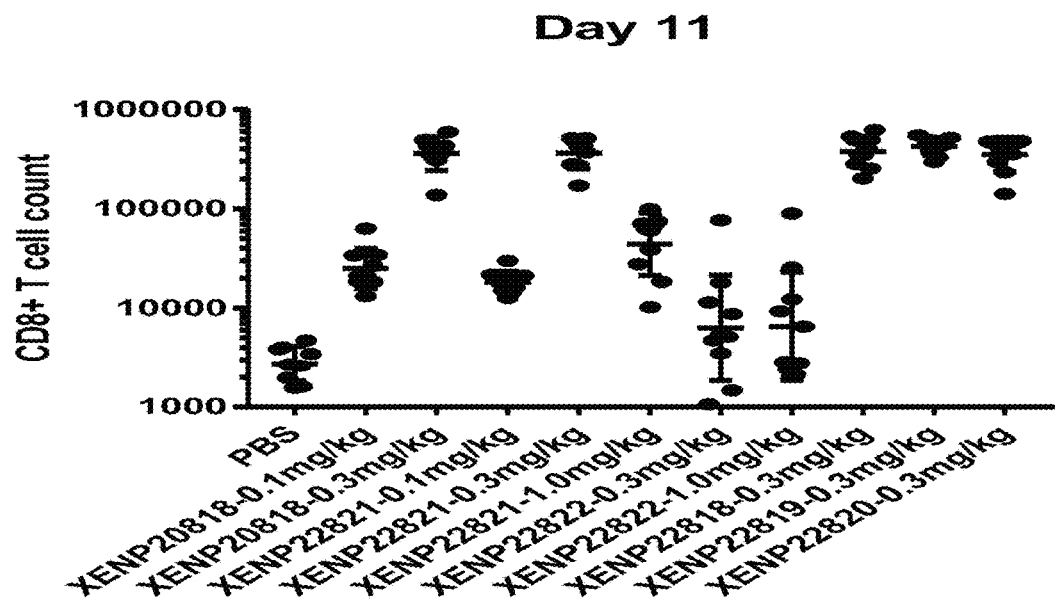

FIGS. 75A-75B depict CD8+ T cell (CD8+CD45RA+) counts on Days (A) 7 and (B) 11 after treatment of NSG mice engrafted with human PBMCs with the indicated IL15/Rα-Fc fusion proteins or control.

Figure 76A:
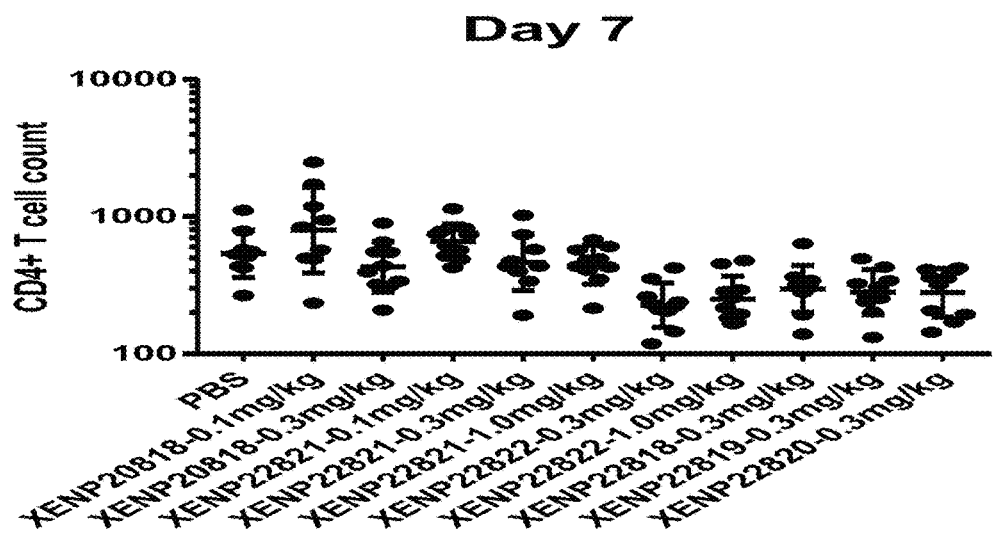
Figure 76B:
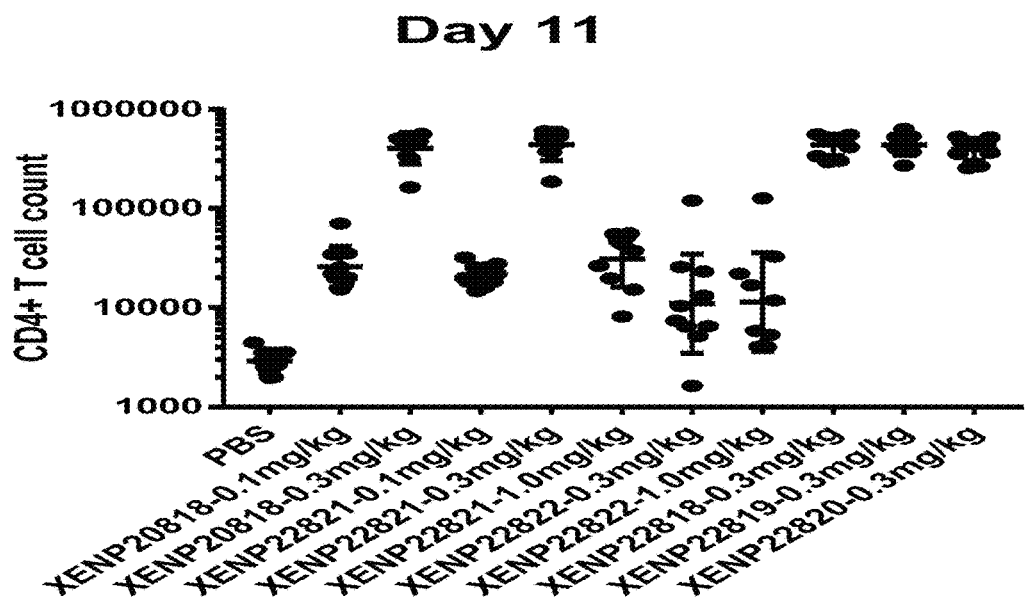

FIGS. 76A-76B depict CD4+ T cell (CD4+CD45RA+) counts on Days A) 7 and B) 11 after treatment of NSG mice engrafted with human PBMCs with the indicated IL15/Rα-Fc fusion proteins or control.

Figure 77:
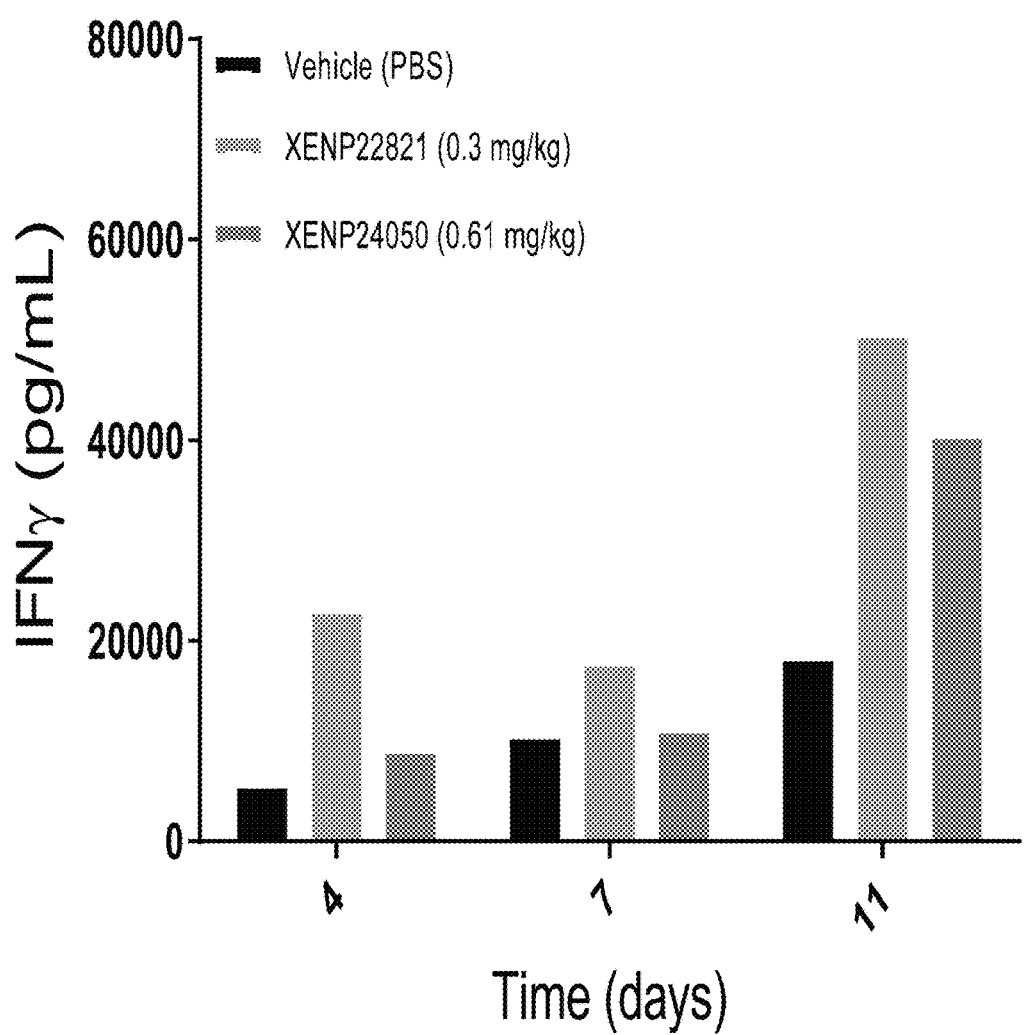

FIG. 77 depicts IFNγ level on Days 4, 7, and 11 in serum of huPBMC engrafted mice following treatment with additional variant IL-15/Rα-Fc fusion proteins.

Figure 78A:
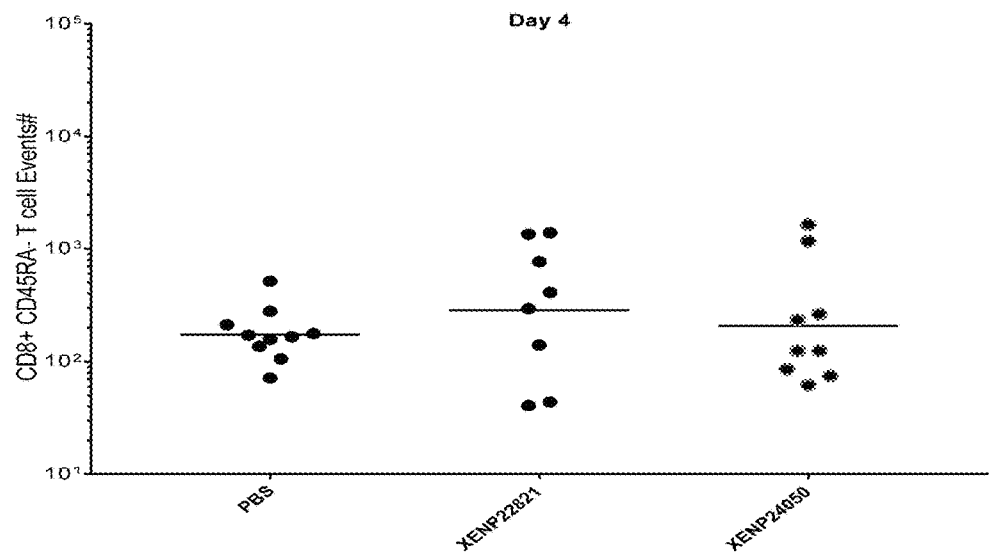
Figure 78B:
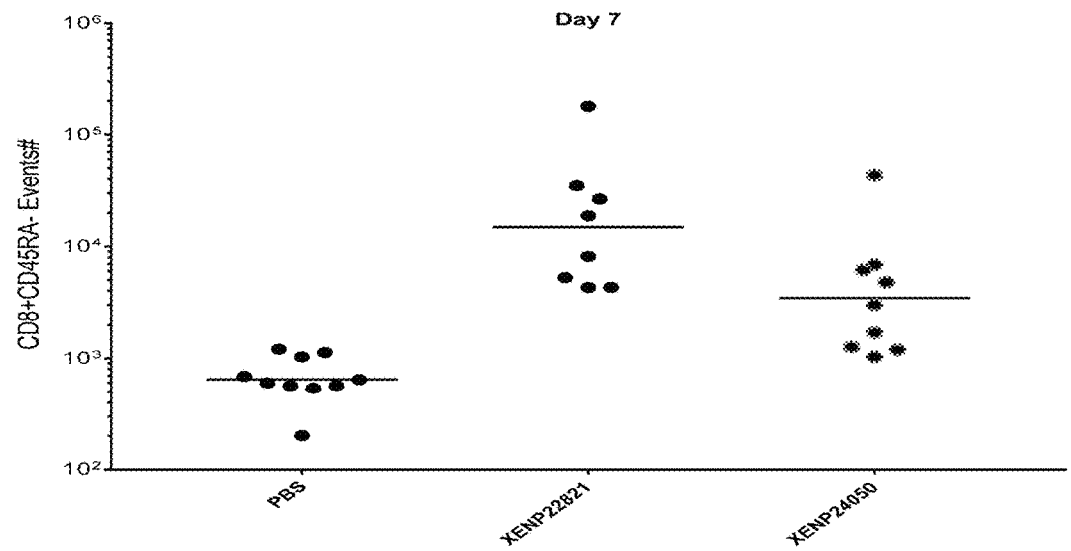
Figure 78C:
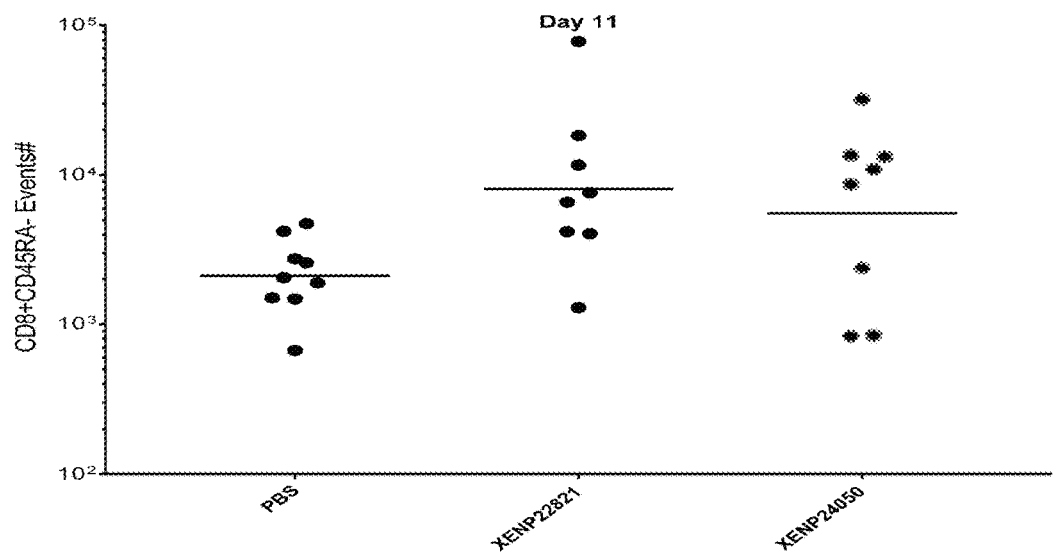

FIGS. 78A-78C depict CD8+ T cell count on Days (A) 4, (B) 7, and (C) 11 in whole blood of huPBMC engrafted mice following treatment with additional variant IL-15/Rα-Fc fusion proteins.

Figure 79A:
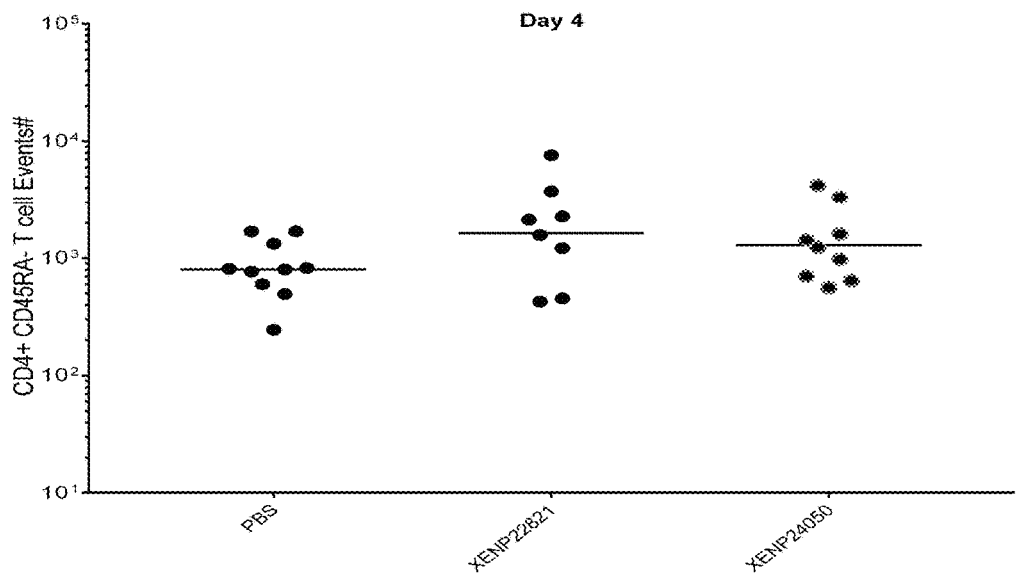
Figure 79B:
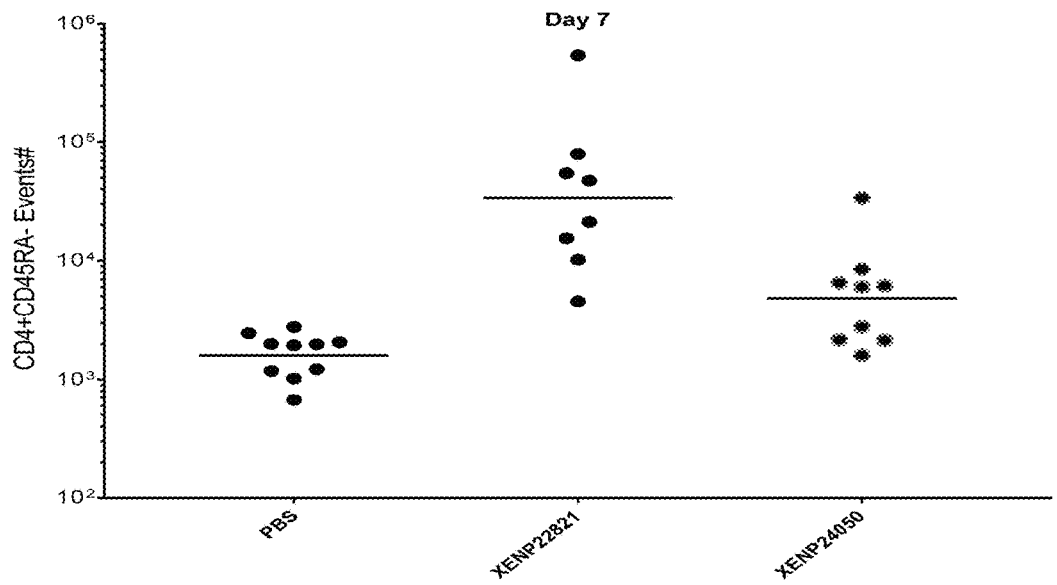
Figure 79C:
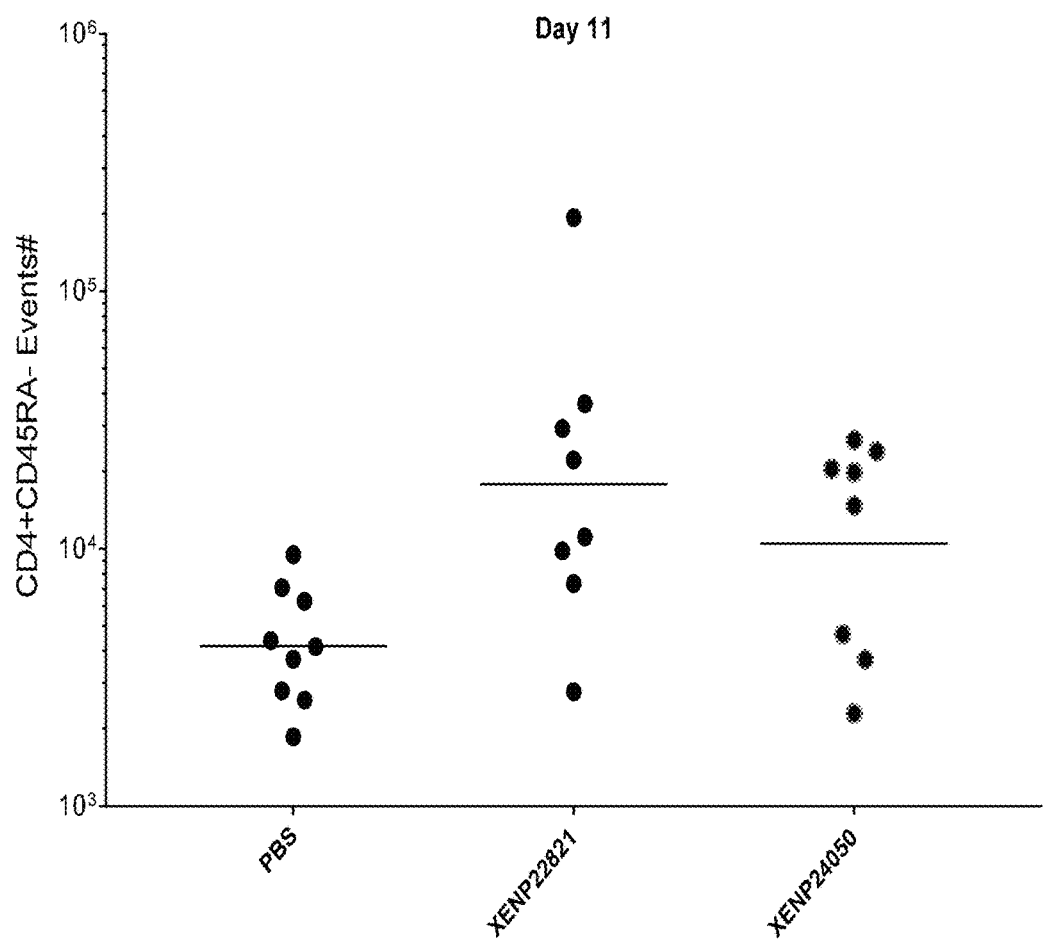

FIGS. 79A-79C depict CD4+ T cell count on Days (A) 4, (B) 7, and (C) 11 in whole blood of huPBMC engrafted mice following treatment with additional variant IL-15/Rα-Fc fusion proteins.

Figure 80A:
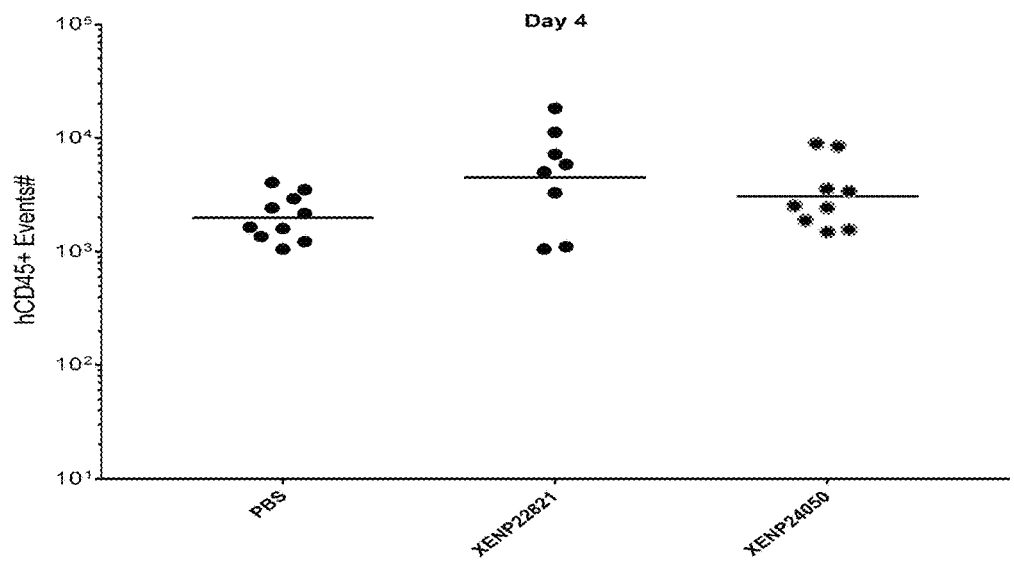
Figure 80B:
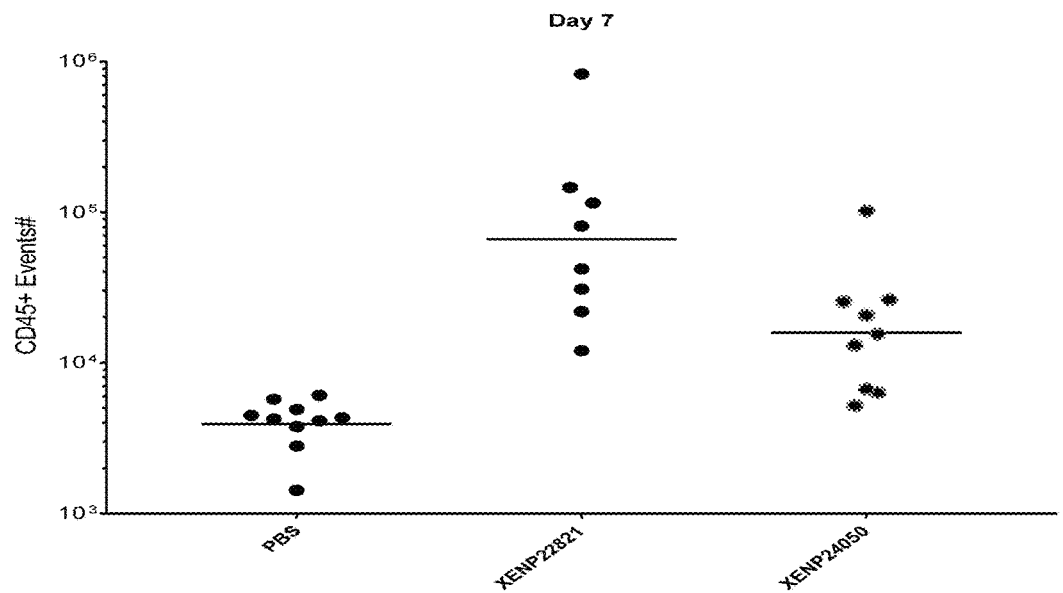
Figure 80C:
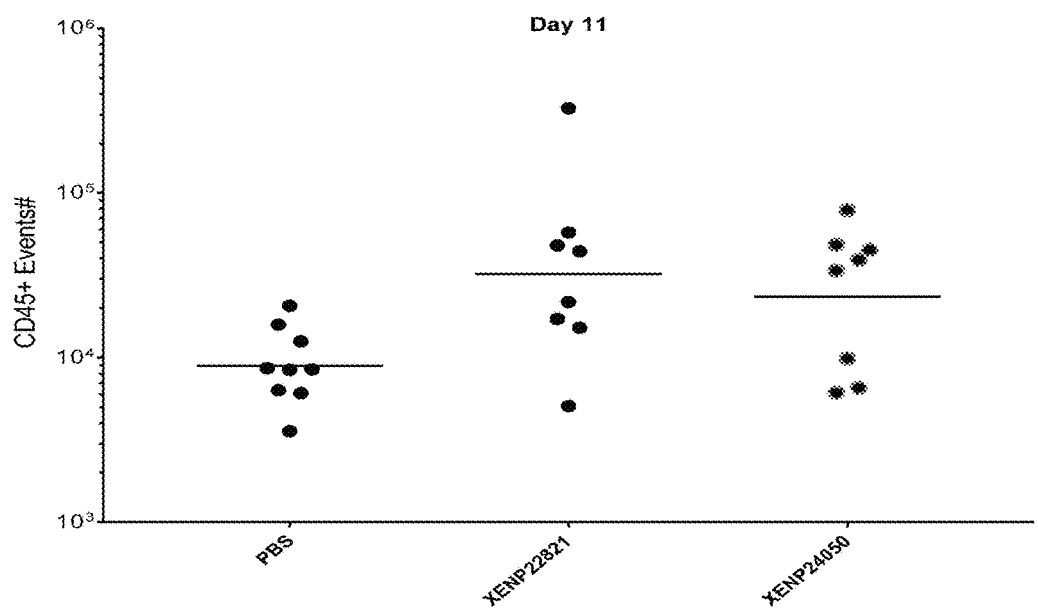

FIGS. 80A-80C depict CD45+ cell count on Days (A) 4, (B) 7, and (C) 11 in whole blood of huPBMC engrafted mice following treatment with additional variant IL-15/Rα-Fc fusion proteins.

Figure 81A:
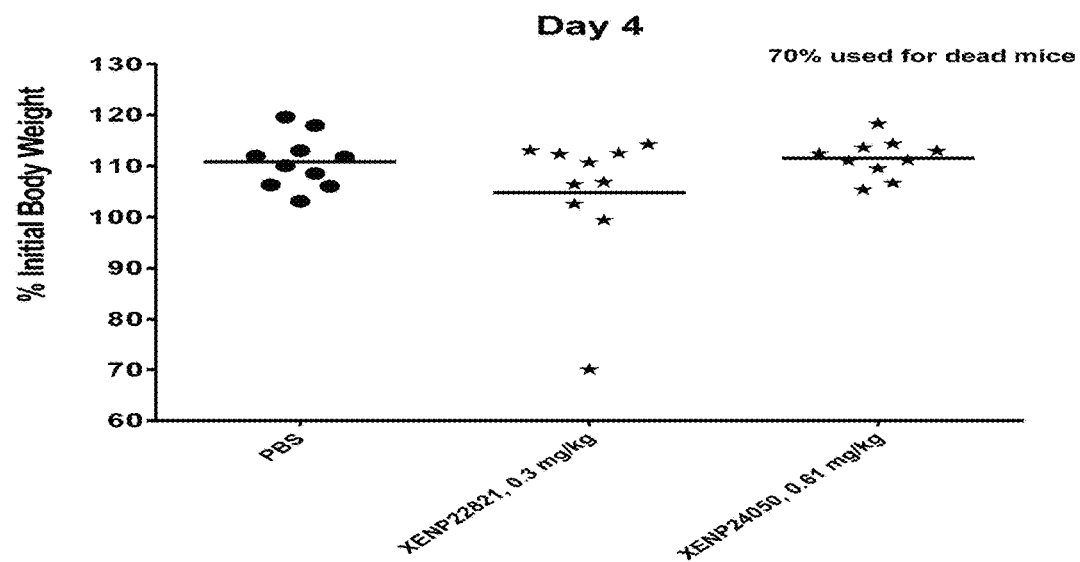
Figure 81B:
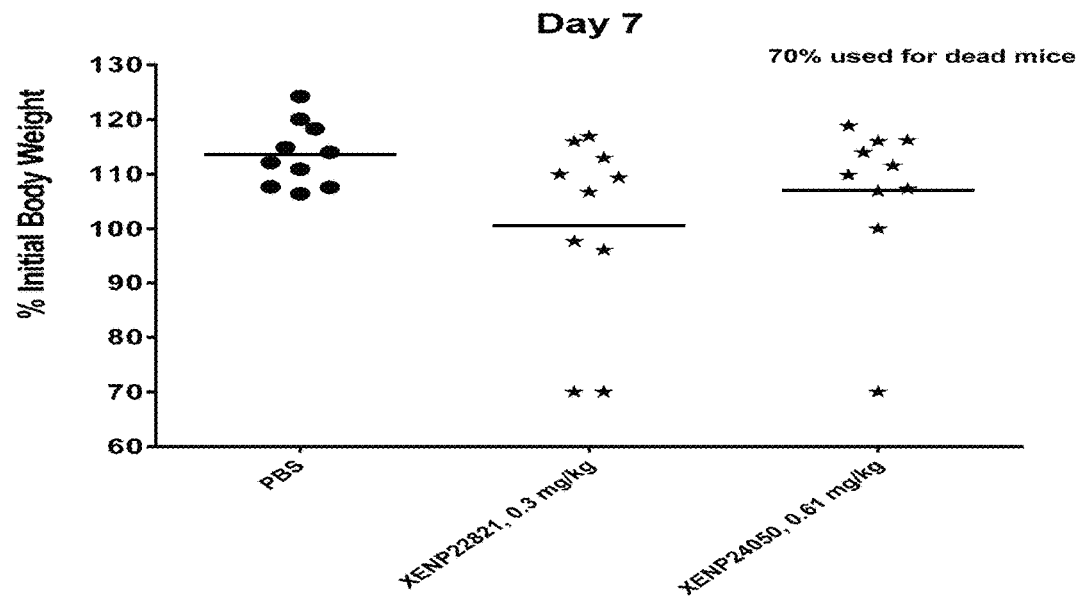
Figure 81C:
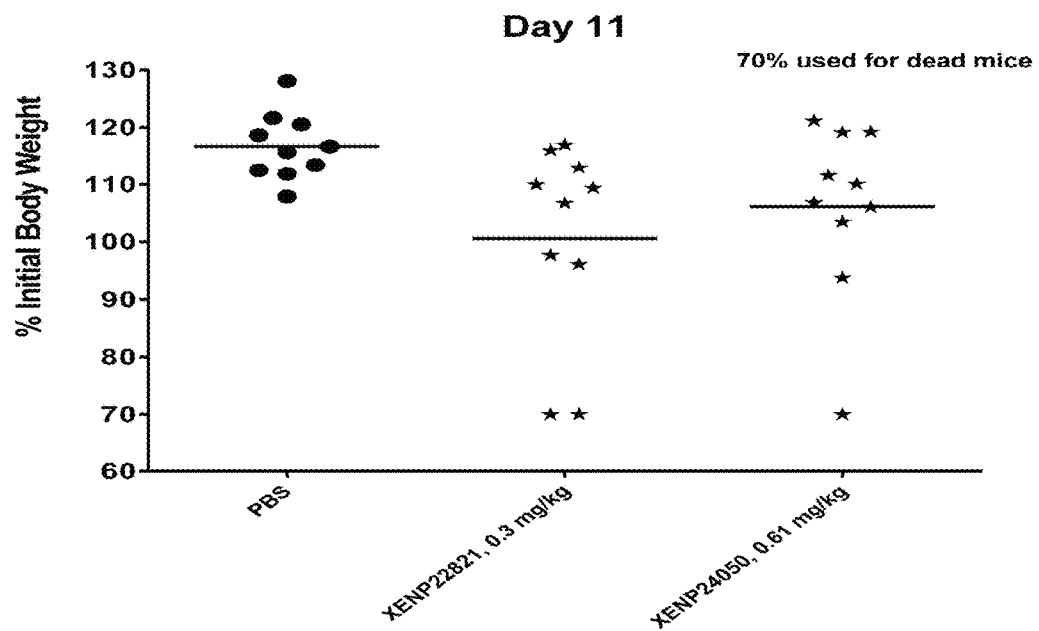

FIGS. 81A-81C depict the body weight as a percentage of initial body weight of huPBMC engrafted mice on Days (A) 4, (B) 7, and (C) 11 following treatment with additional IL-15/Rα variants. Each point represents a single NSG mouse. Mice whose body weights dropped below 70% initial body weight were euthanized. Dead mice are represented as 70%.

Figure 82A:
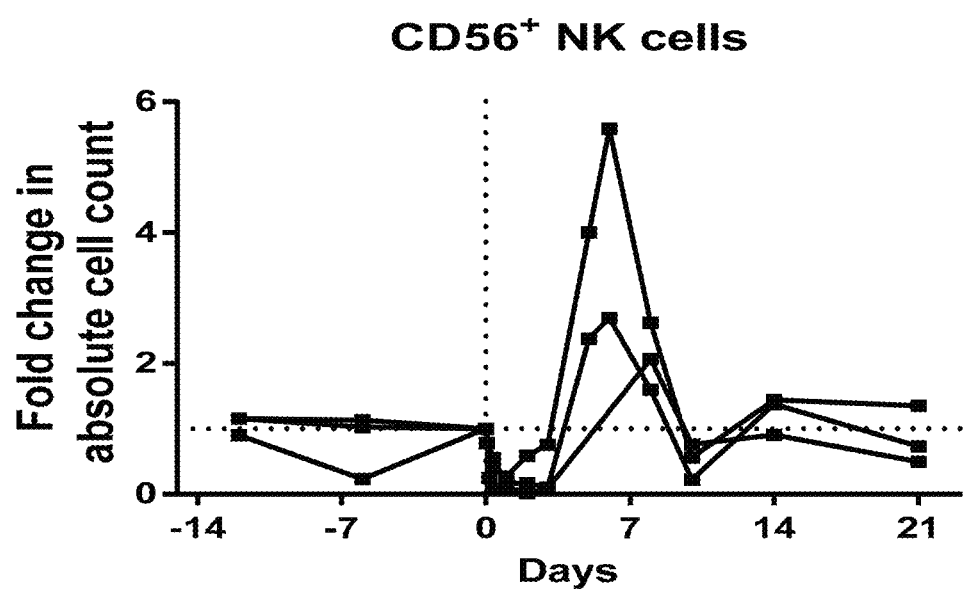
Figure 82B:
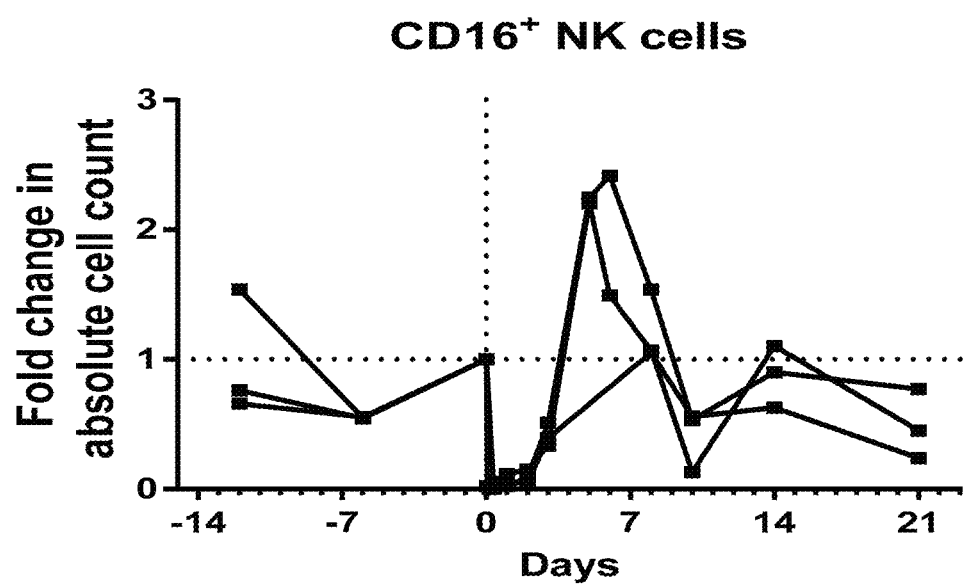
Figure 82C:
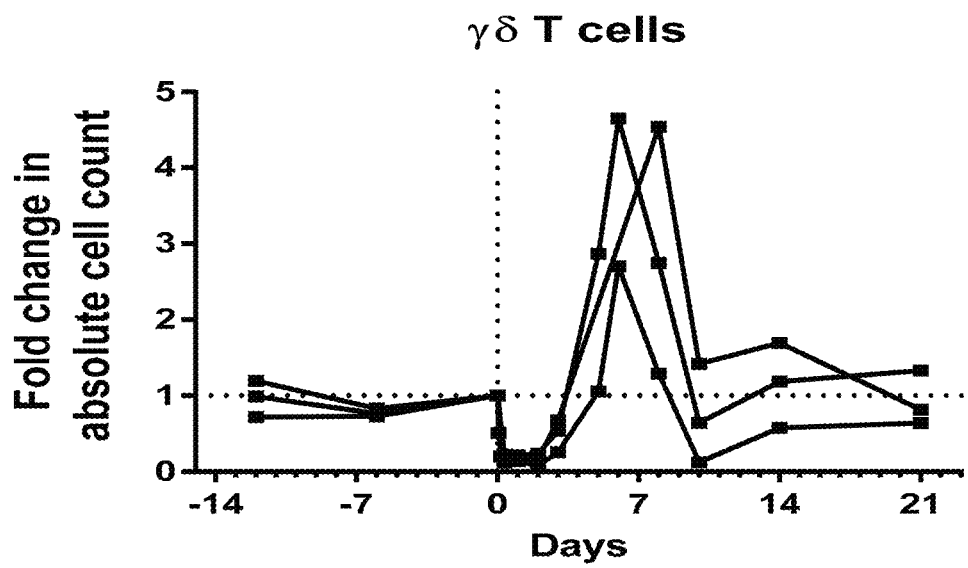
Figure 82D:
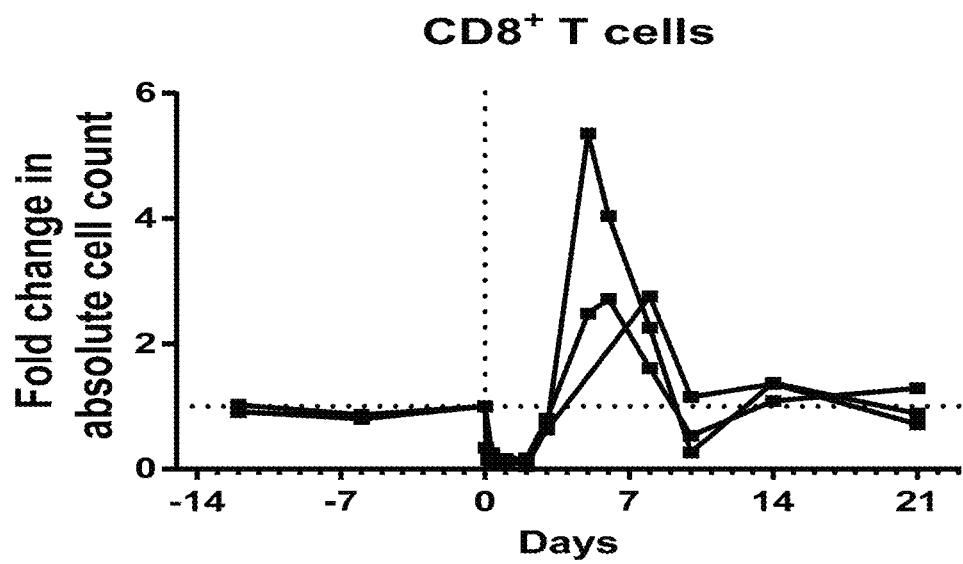
Figure 82E:
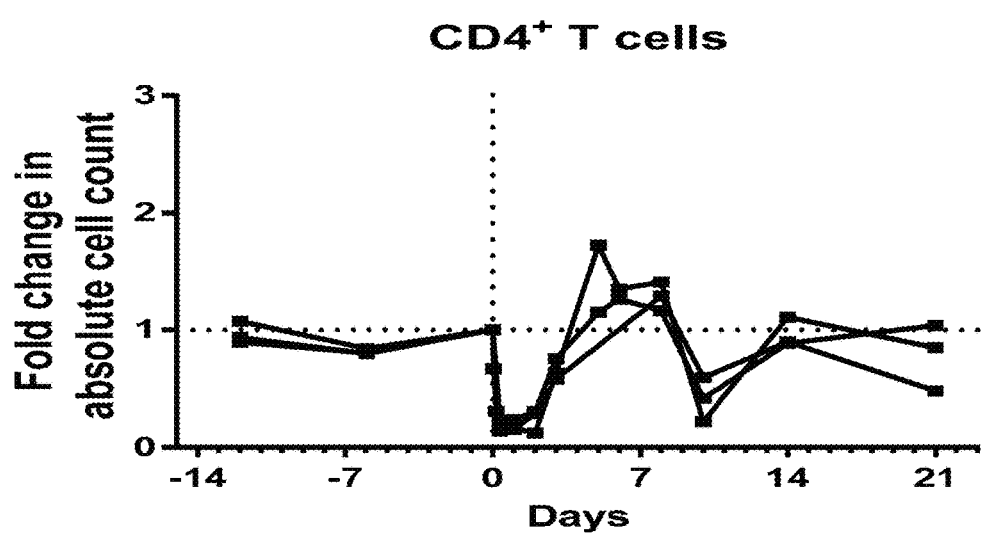
Figure 83A:
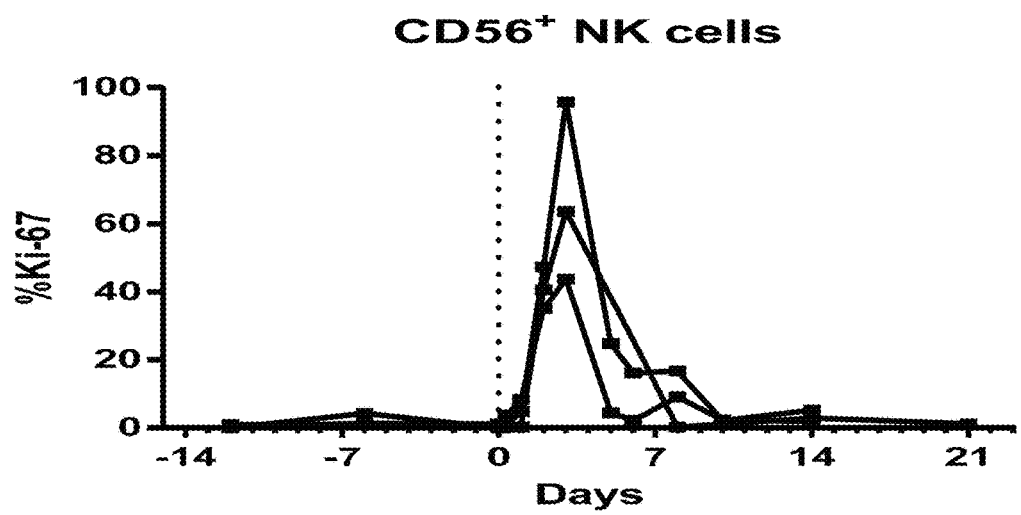
Figure 83B:
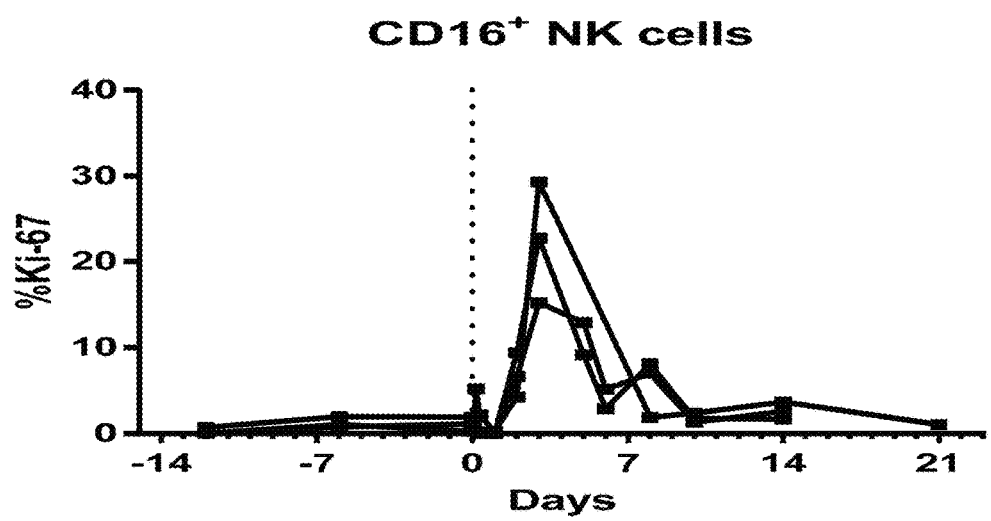
Figure 83C:
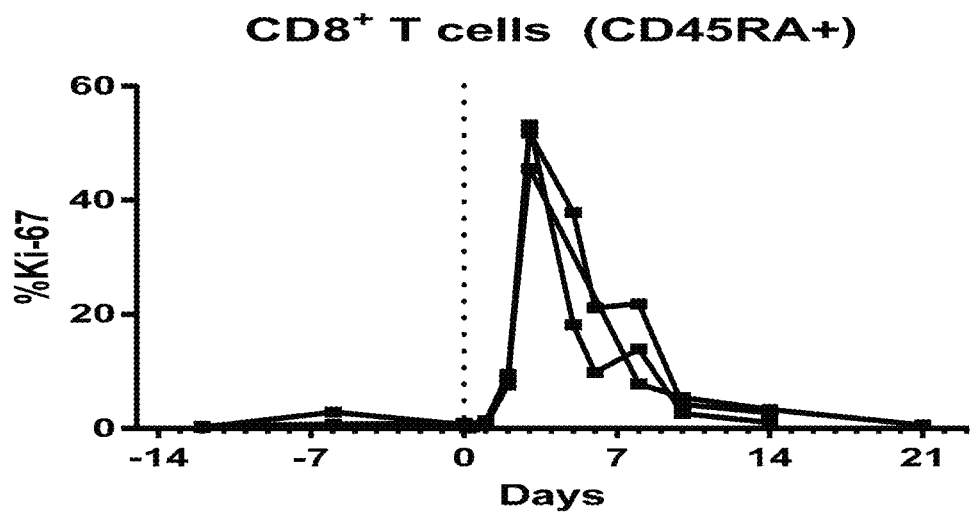
Figure 83D:
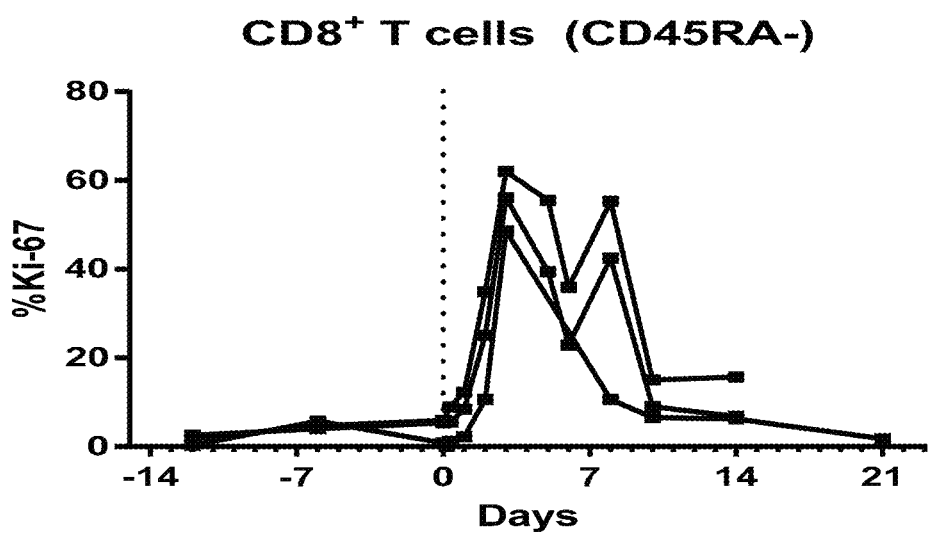
Figure 83E:
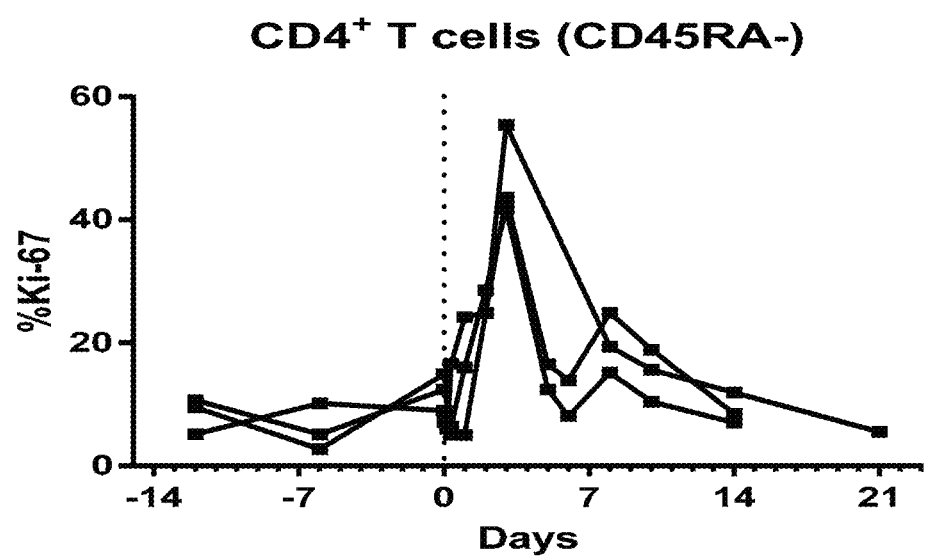

FIGS. 82A-82E depict lymphocyte counts after dosing cynomolgus monkeys with XENP20818. FIGS. 82A-E respectively show the fold change in absolute count of CD56+ NK cells (FIG. 82A), CD16+ NK cells (FIG. 82B), γδ T cells (CD45RA+CD3+CD4-CD8-) (FIG. 82C), CD8+ T cells (FIG. 82D), and CD4+ T cells (FIG. 82E).

FIGS. 83A-83E depict proliferation of CD56+ NK cells (FIG. 83A), CD16+ NK cells (FIG. 83B), CD8+ T cells (CD45RA+) (FIG. 83C), CD8+ T cells (CD45RA–) (FIG. 83D), and CD4+ T cells (CD45RA–) (FIG. 83E) after dosing cynomolgus monkeys with XENP20818.

Figure 84A:
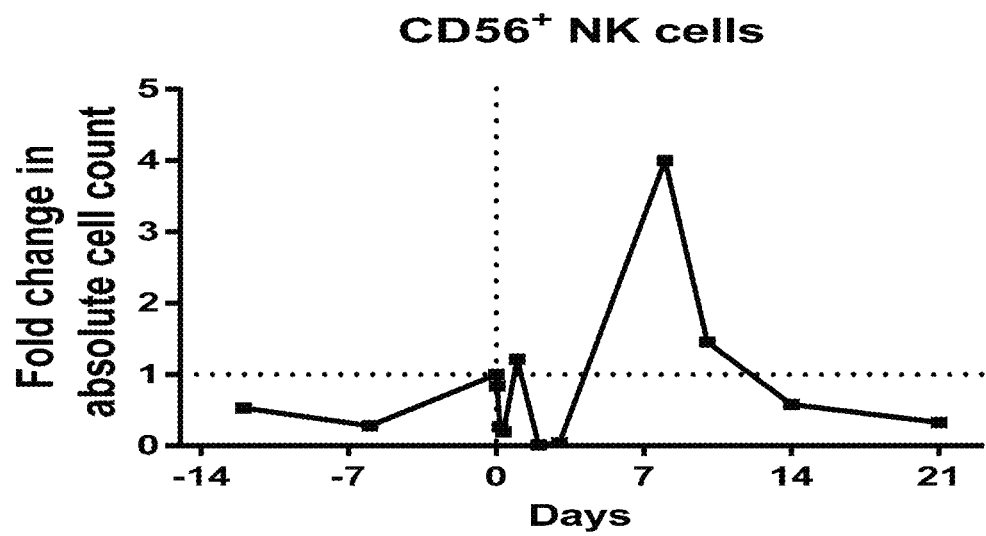
Figure 84B:
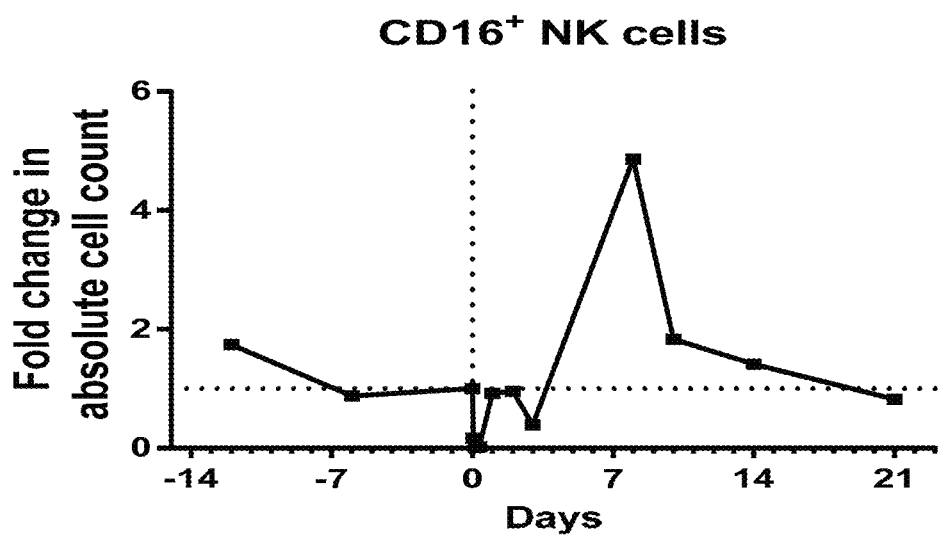
Figure 84C:
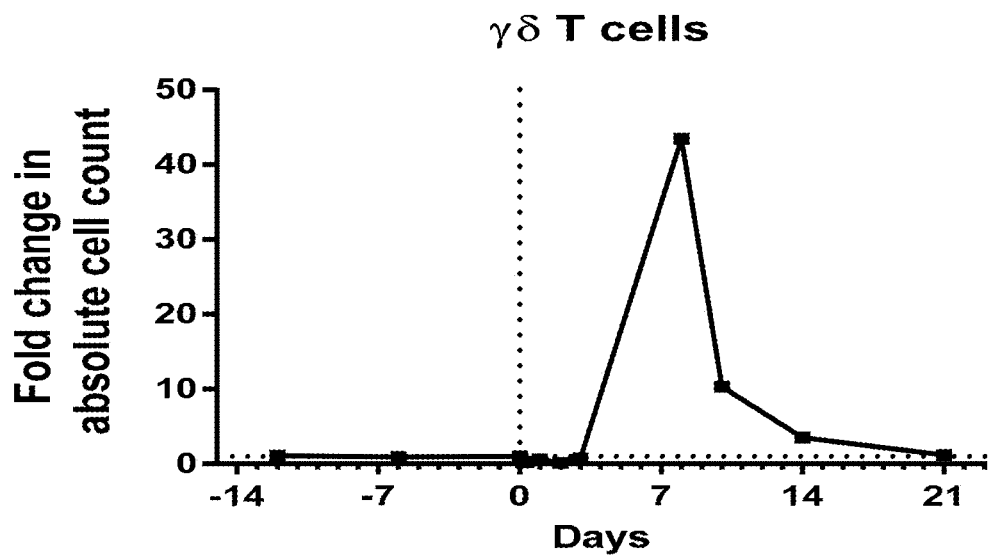
Figure 84D:
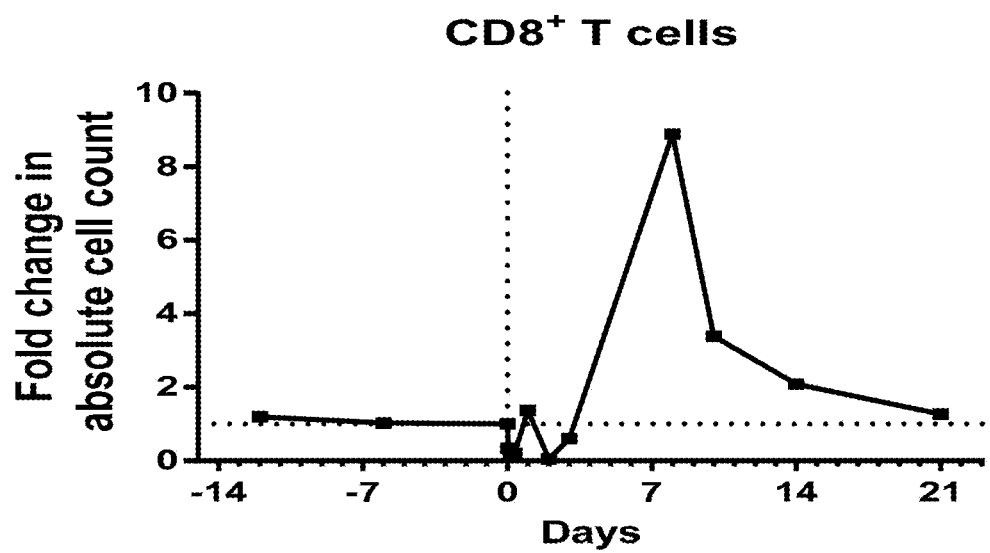
Figure 84E:
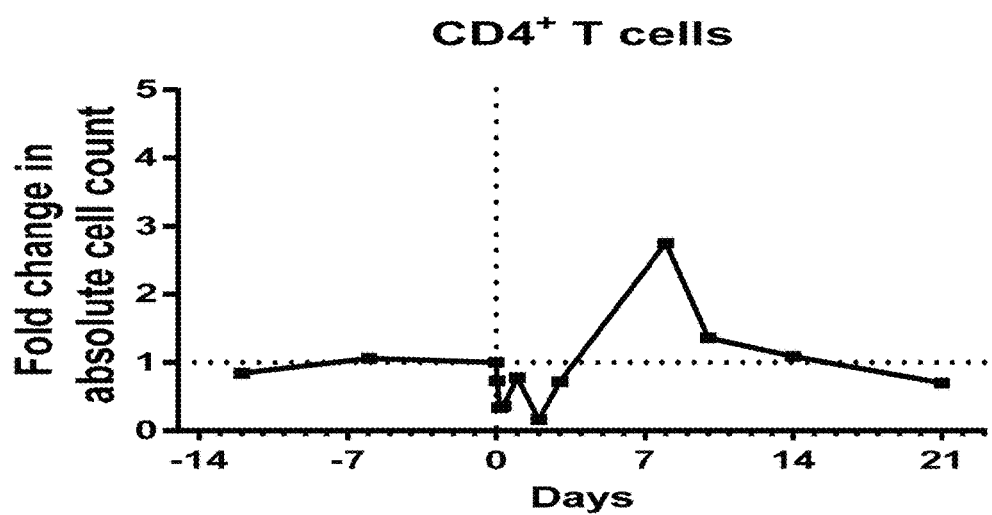
Figure 85A:
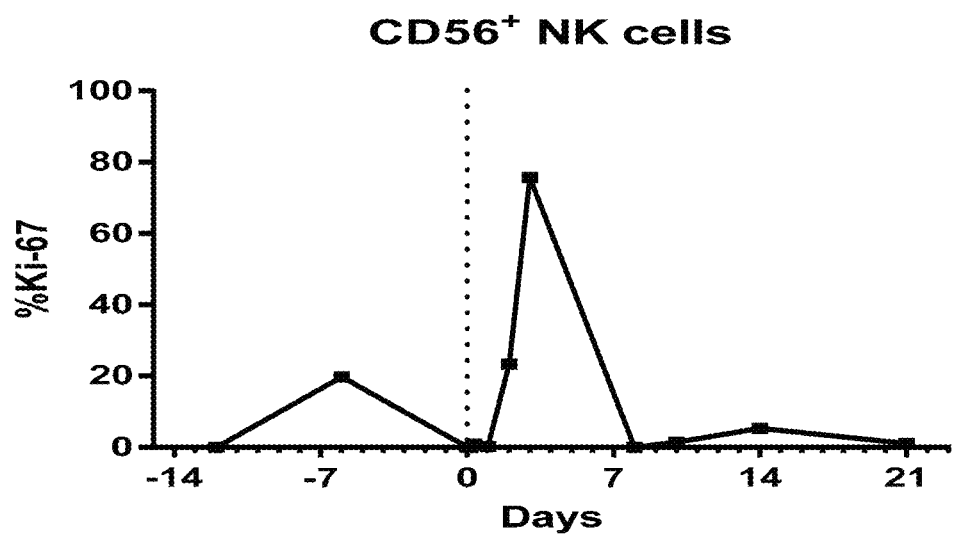
Figure 85B:
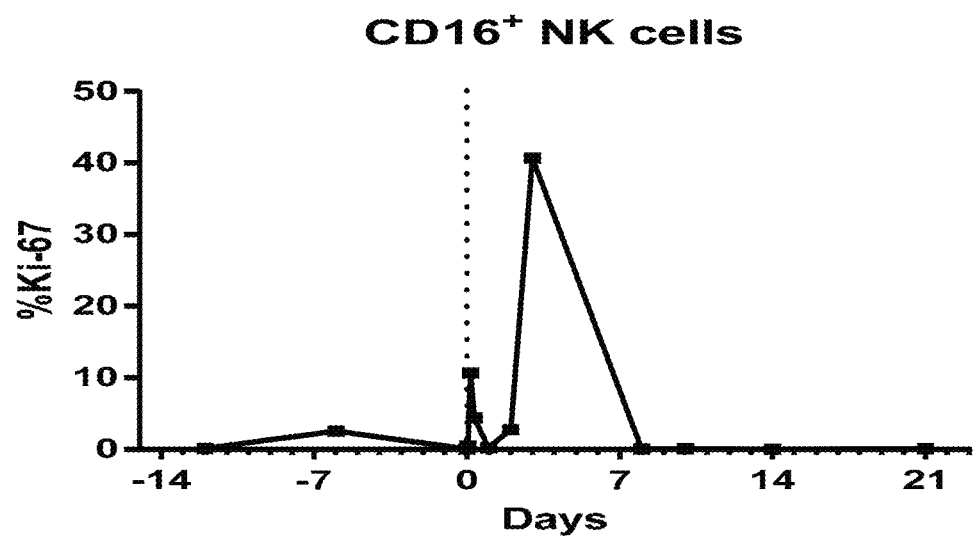
Figure 85C:
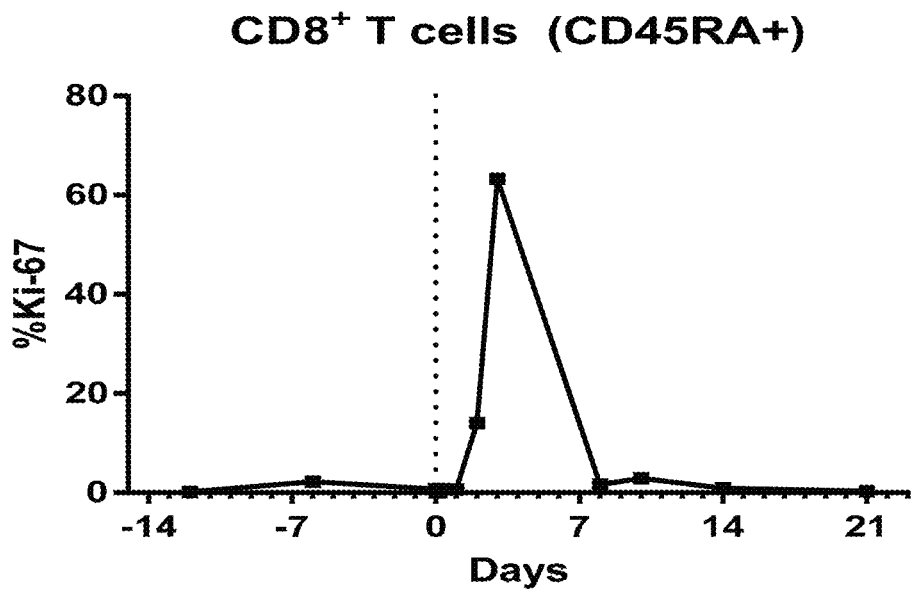
Figure 85D:
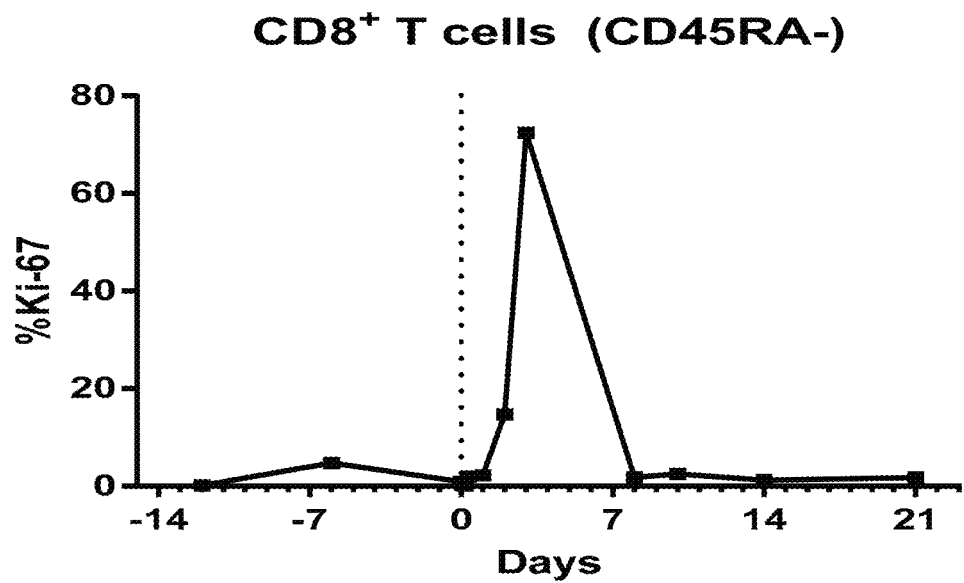
Figure 85E:
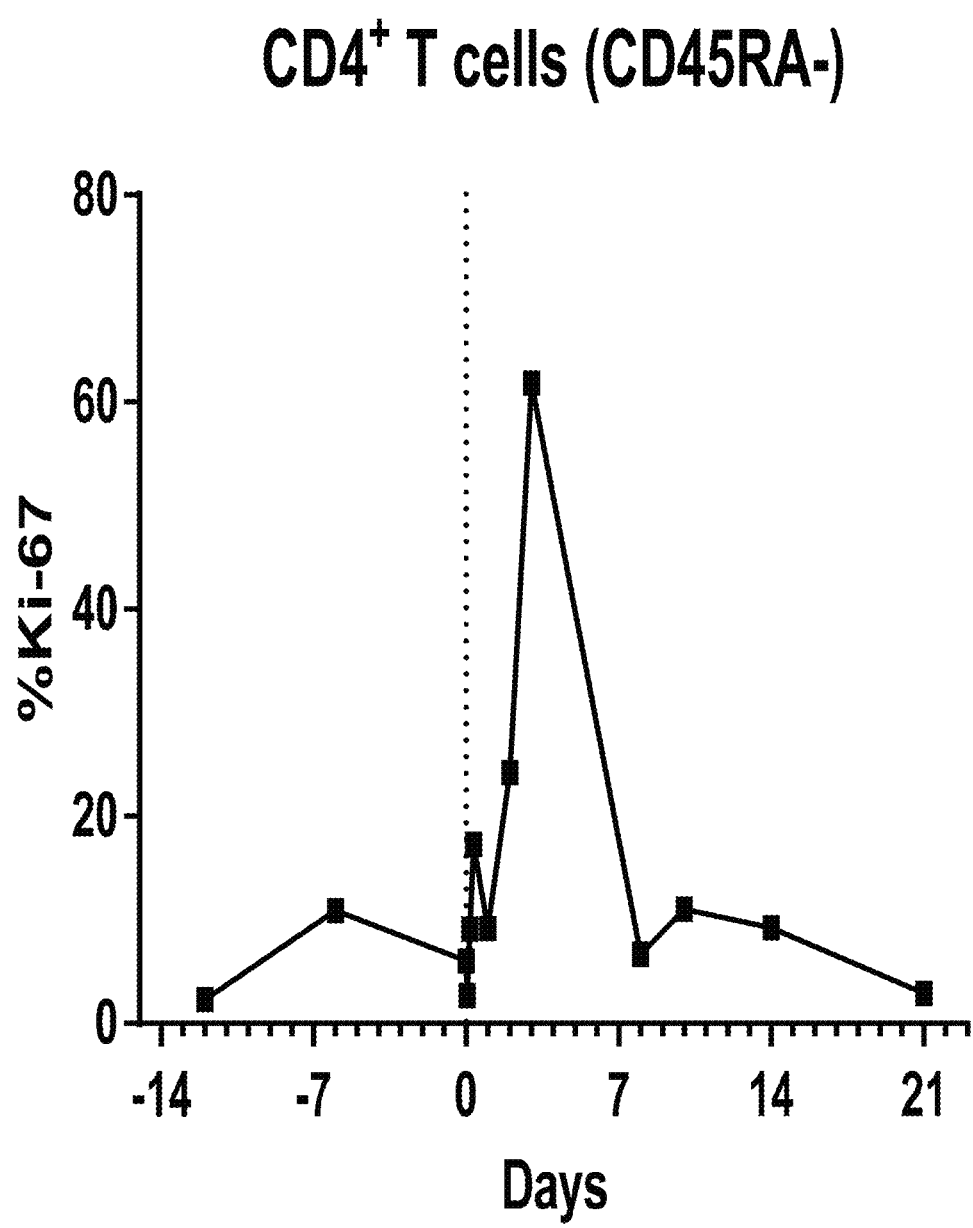

FIGS. 84A-84E depict lymphocyte counts after dosing cynomolgus monkeys with XENP22819. FIGS. 84A-E respectively show the fold change in absolute count of CD56+ NK cells (FIG. 84A), CD16+ NK cells (FIG. 84B), γδ T cells (CD45RA+CD3+CD4–CD8–) (FIG. 84C), CD8+ T cells (FIG. 84D), and CD4+ T cells (FIG. 84E).

FIGS. 85A-85E depict proliferation of CD56+ NK cells (FIG. 85A), CD16+ NK cells (FIG. 85B), CD8+ T cells (CD45RA+) (FIG. 85C), CD8+ T cells (CD45RA–) (FIG. 85D), and CD4+ T cells (CD45RA–) (FIG. 85E) after dosing cynomolgus monkeys with XENP22819.

Figure 86A:
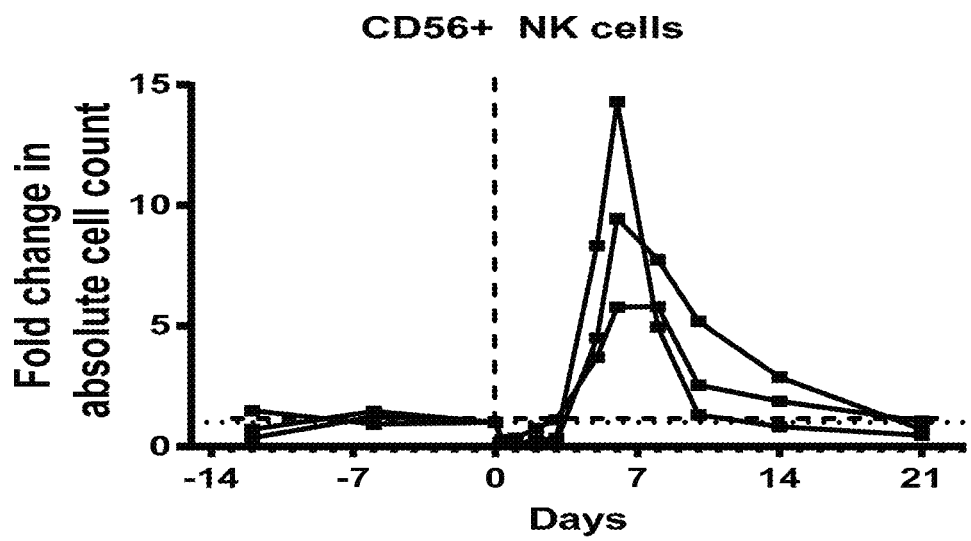
Figure 86B:
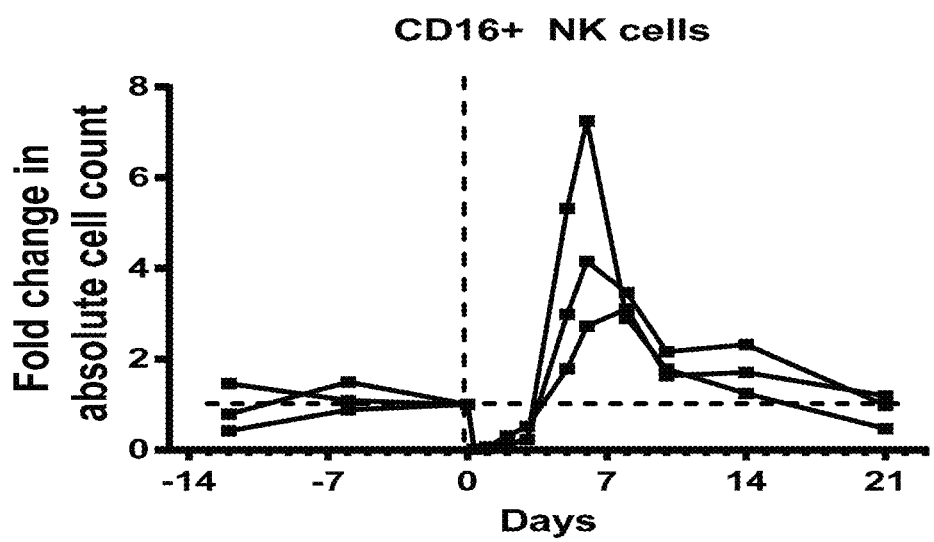
Figure 86C:
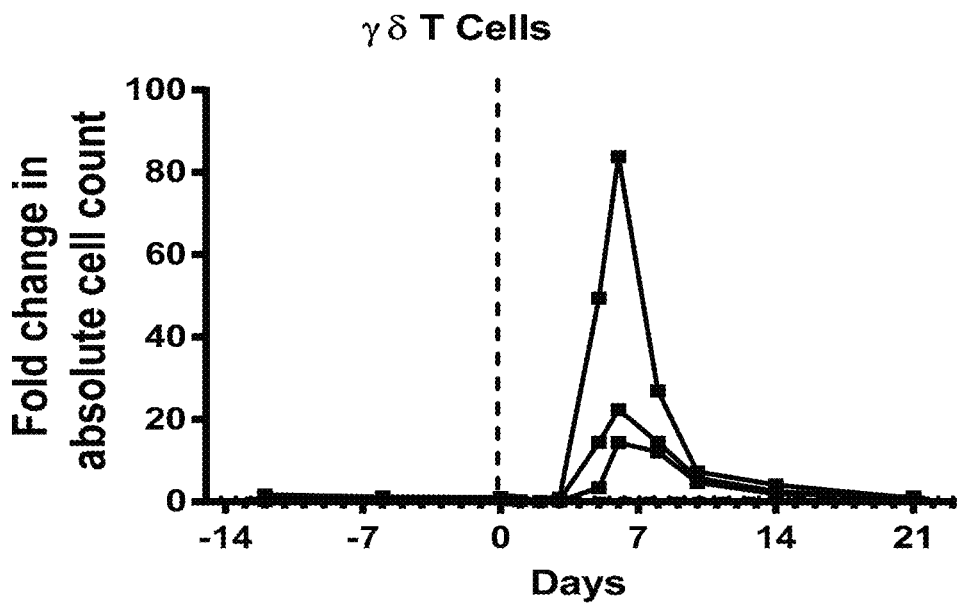
Figure 86D:
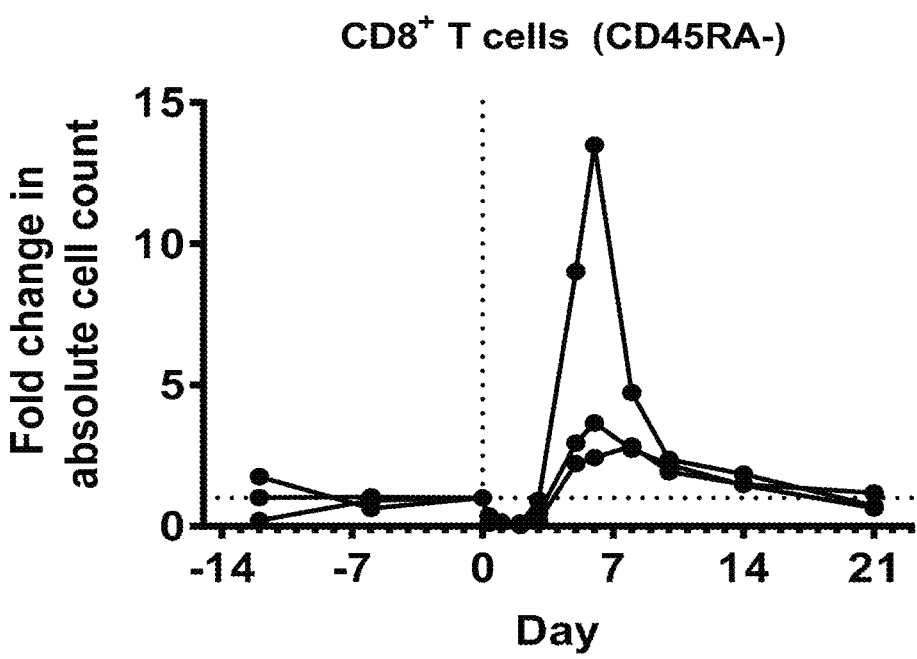
Figure 86E:
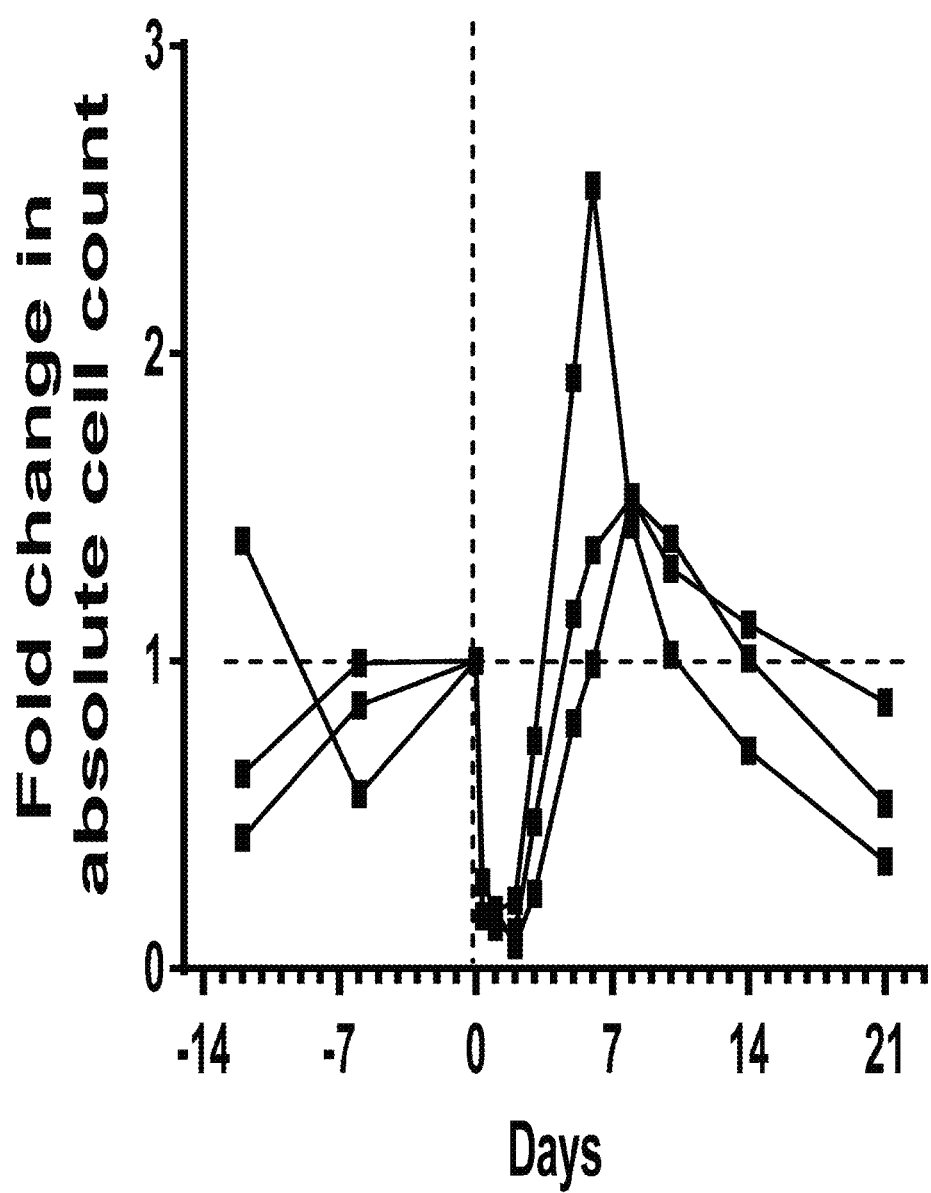
Figure 87A:
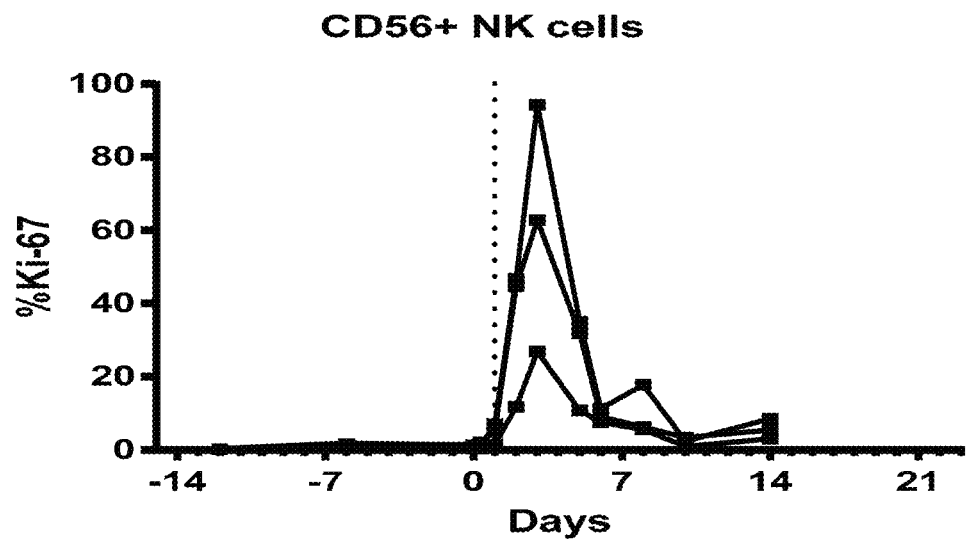
Figure 87B:
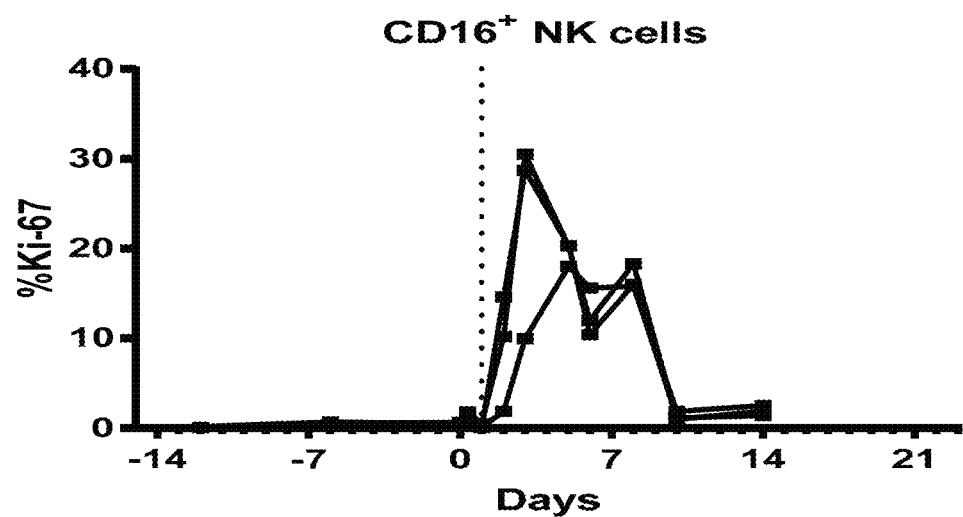
Figure 87C:
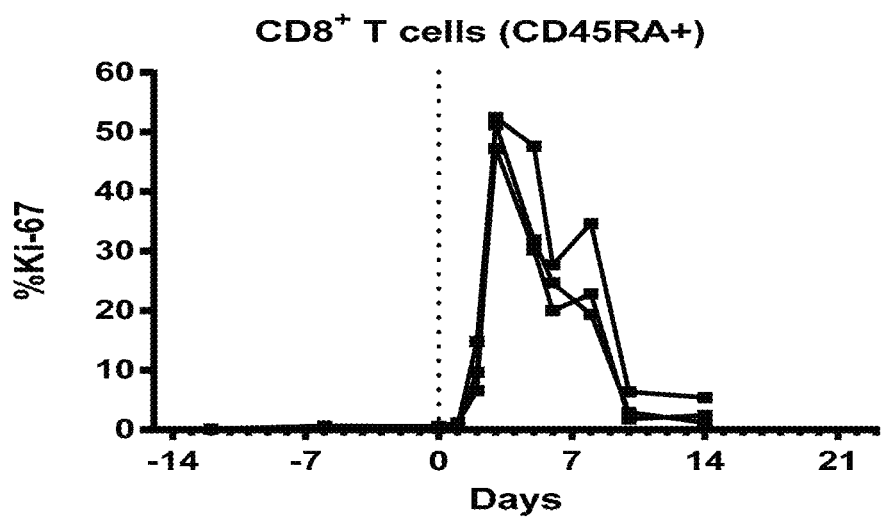
Figure 87D:
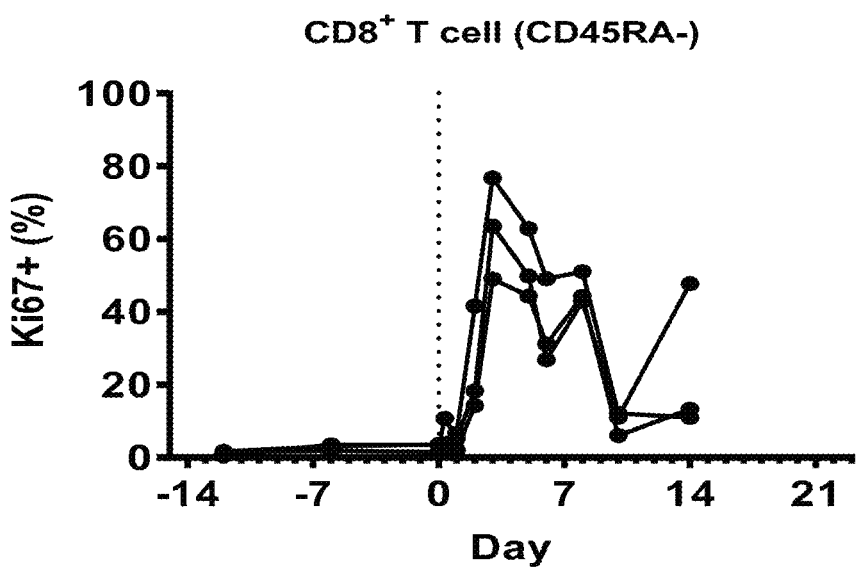
Figure 87E:
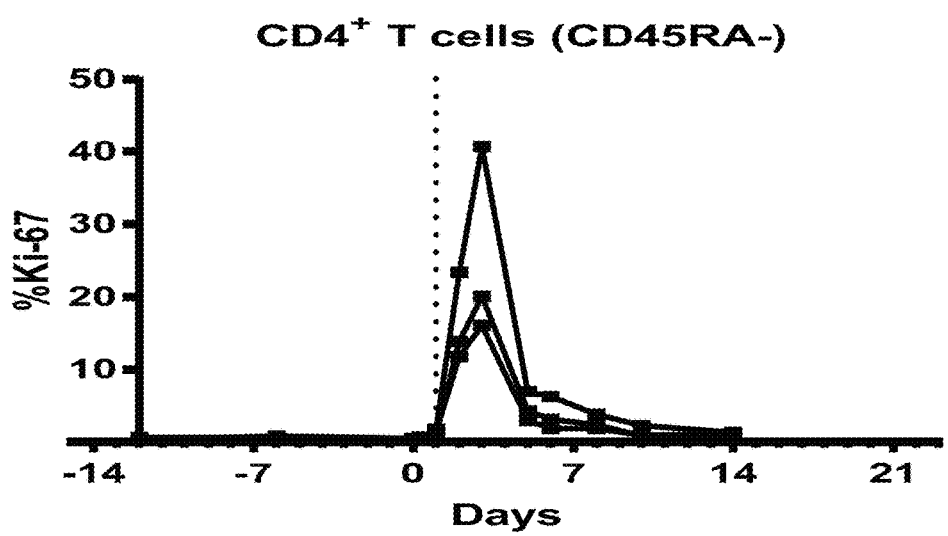

FIGS. 86A-86E depict lymphocyte counts after dosing cynomolgus monkeys with XENP22821. FIGS. 86A-E respectively show the fold change in absolute count of CD56+ NK cells (FIG. 86A), CD16+ NK cells (FIG. 86B), γδ T cells (CD45RA+CD3+CD4–CD8–) (FIG. 86C), CD8+ T cells (FIG. 86D), and CD4+ T cells (FIG. 86E).

FIGS. 87A-87E depict proliferation of CD56+ NK cells (FIG. 87A), CD16+ NK cells (FIG. 87B), CD8+ T cells (CD45RA+) (FIG. 87C), CD8+ T cells (CD45RA–) (FIG. 87D), and CD4+ T cells (CD45RA–) (FIG. 87E) after dosing cynomolgus monkeys with XENP22821.

Figure 88A:
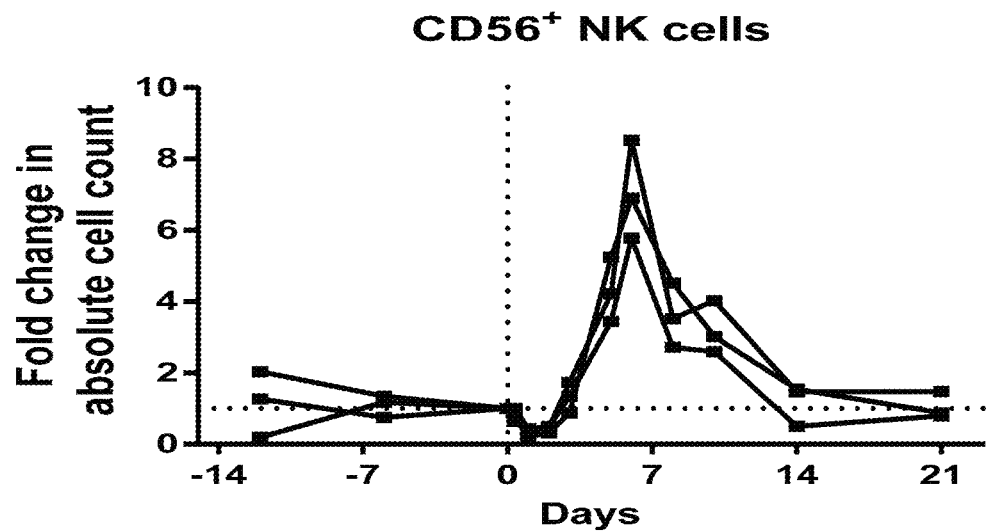
Figure 88B:
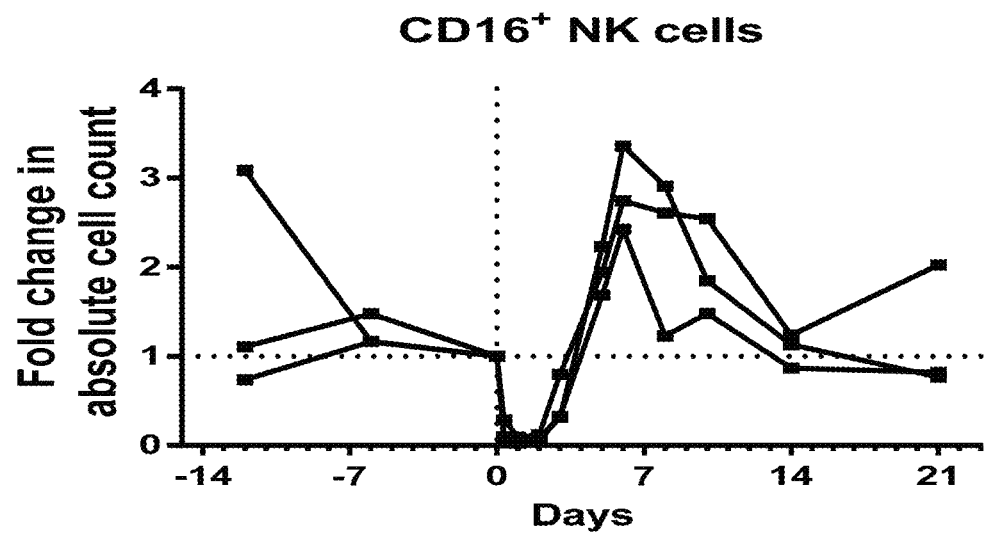
Figure 88C:
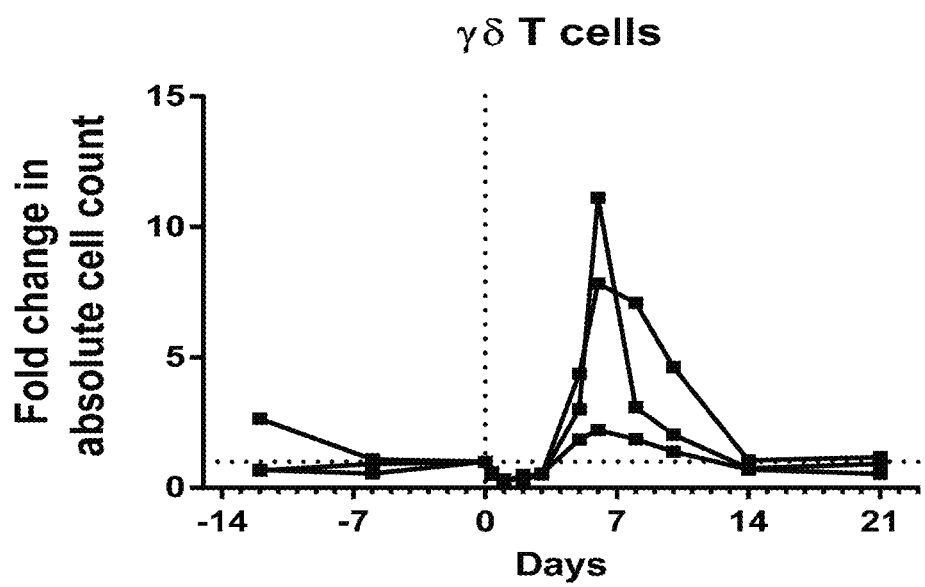
Figure 88D:
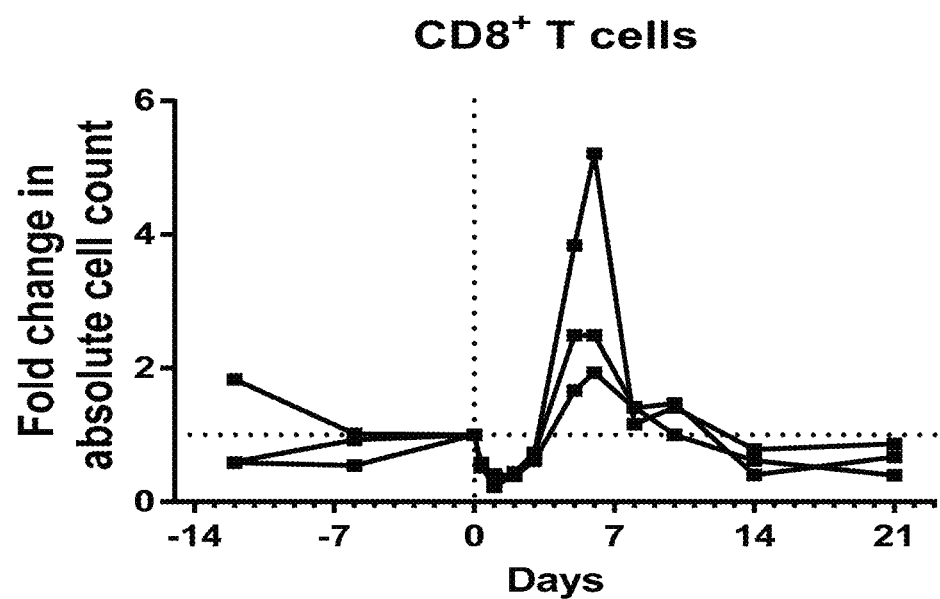
Figure 88E:
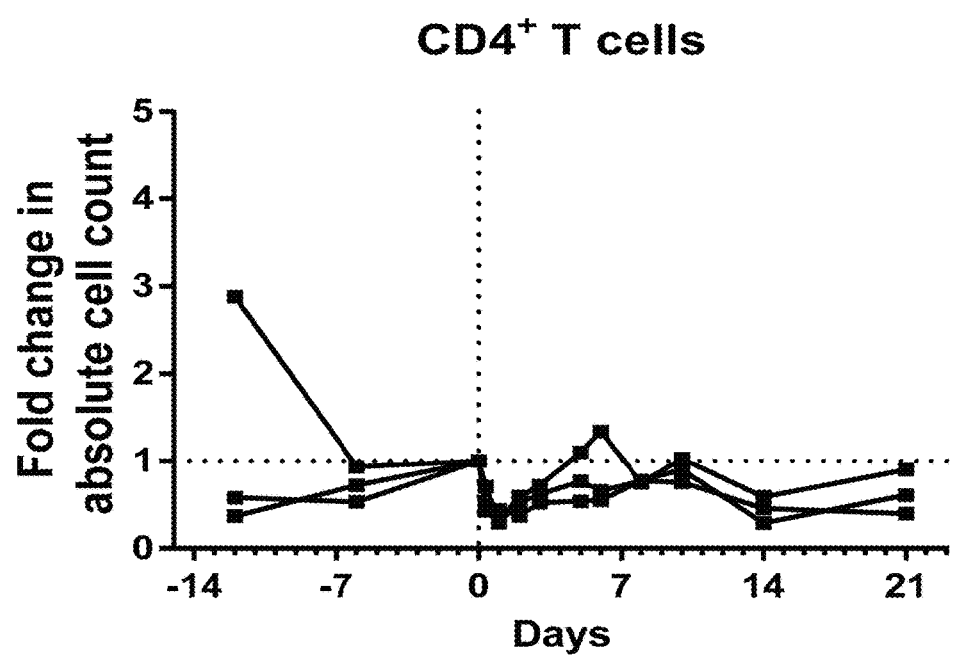
Figure 89A:
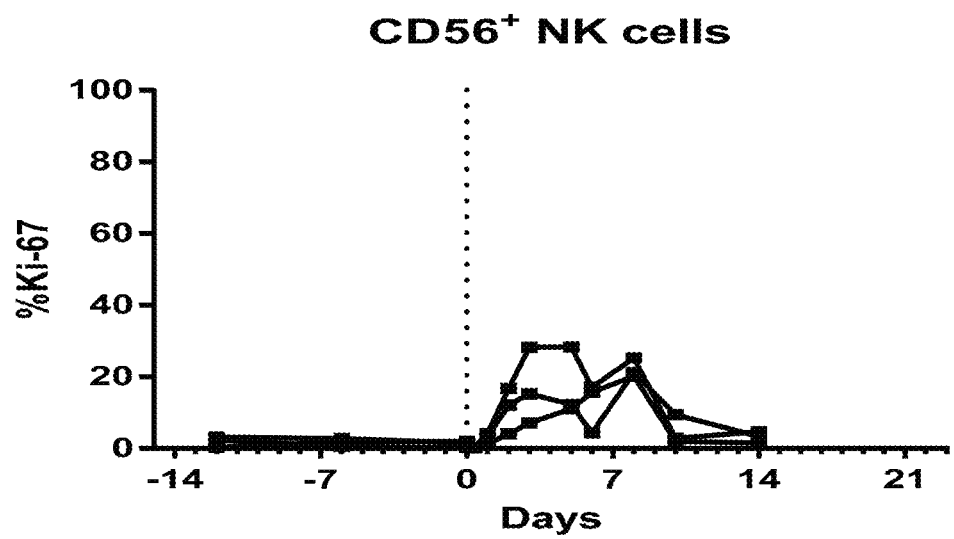
Figure 89B:
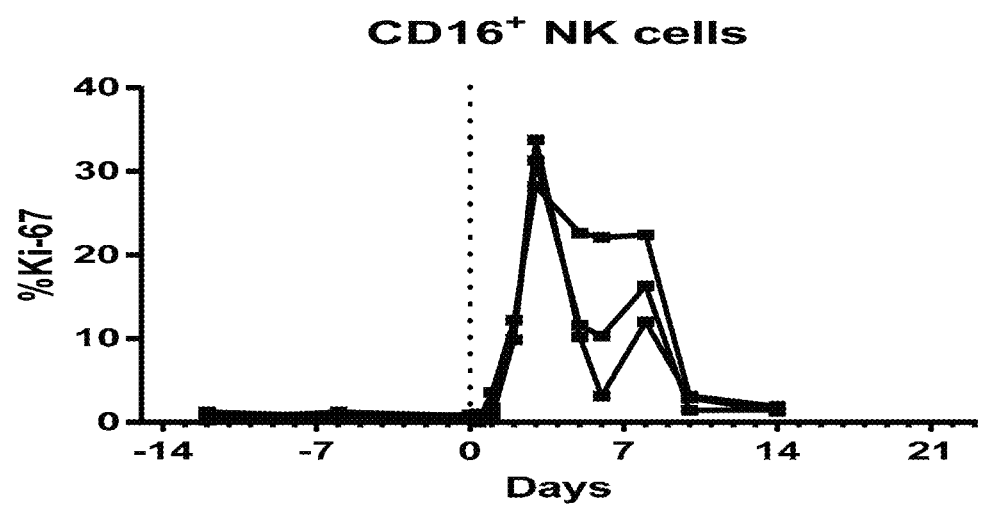
Figure 89C:
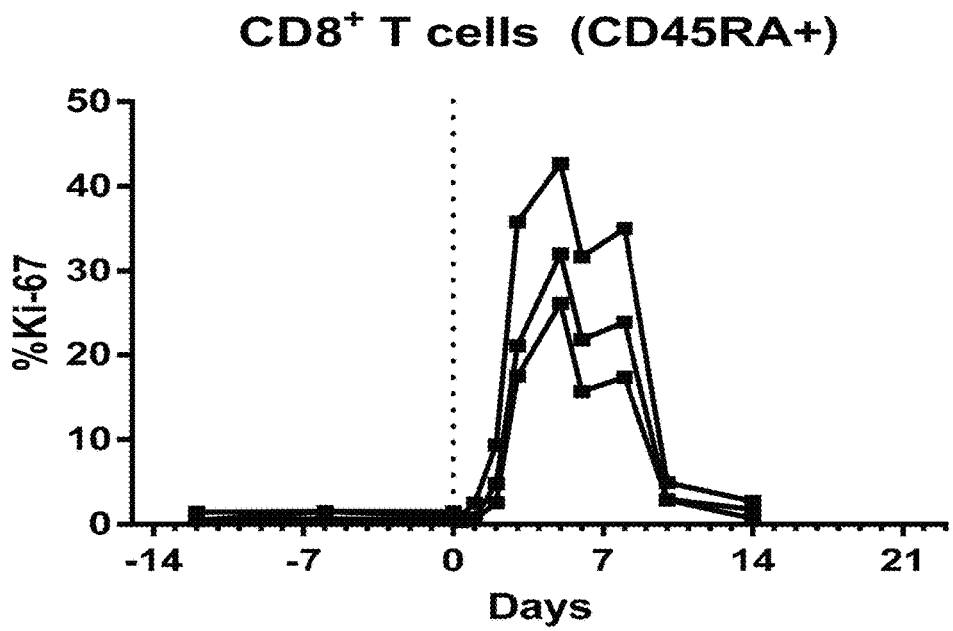
Figure 89D:
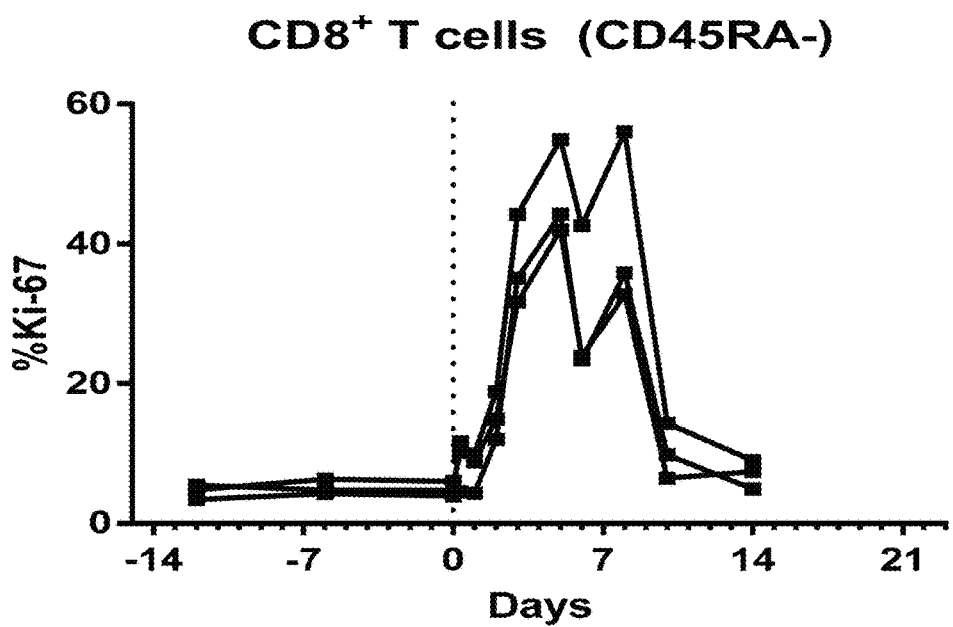
Figure 89E:
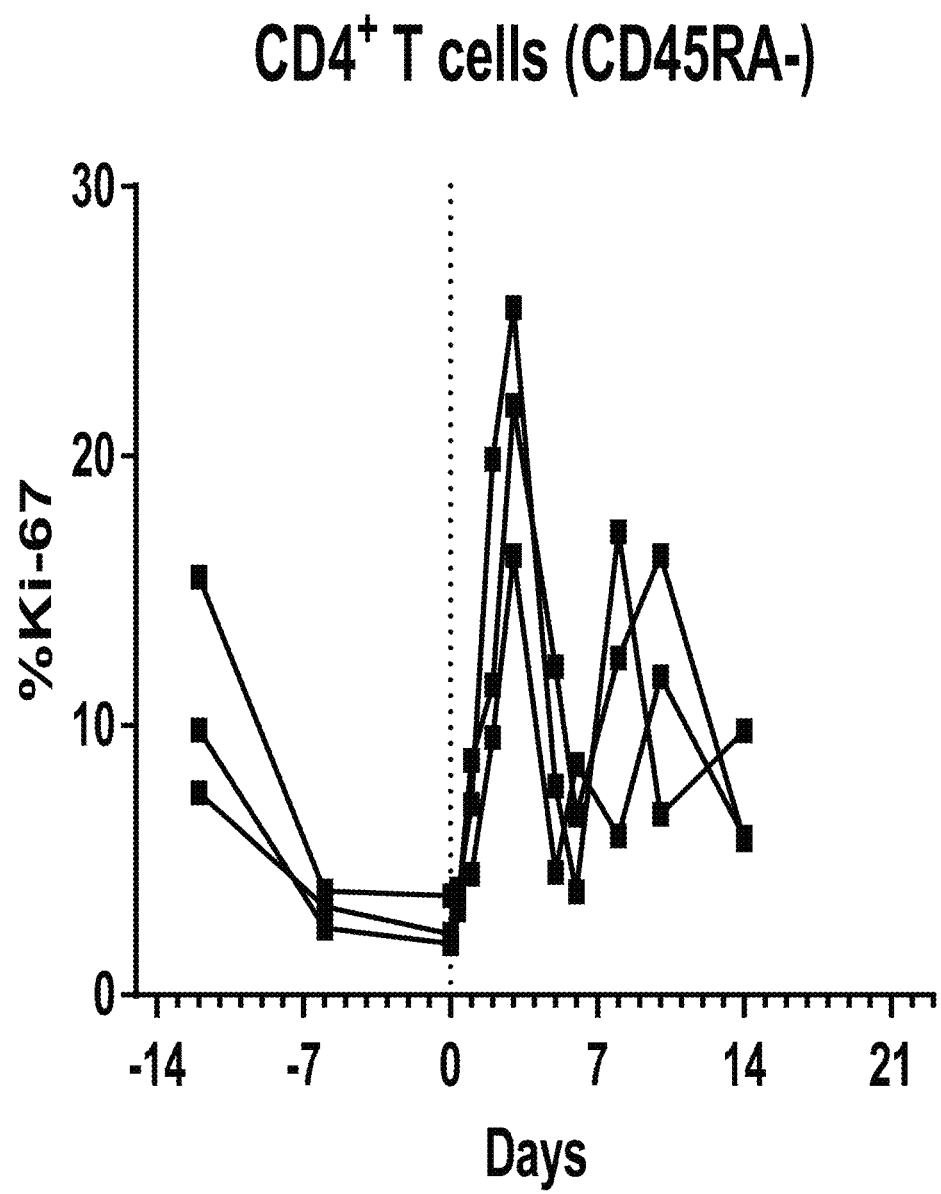

FIGS. 88A-88E depict lymphocyte counts after dosing cynomolgus monkeys with XENP22822. FIGS. 88A-E respectively show the fold change in absolute count of CD56+ NK cells (FIG. 88A), CD16+ NK cells (FIG. 88B), γδ T cells (CD45RA+CD3+CD4–CD8–) (FIG. 88C), CD8+ T cells (FIG. 88D), and CD4+ T cells (FIG. 88E).

FIGS. 89A-89E depict proliferation of CD56+ NK cells (FIG. 89A), CD16+ NK cells (FIG. 89B), CD8+ T cells (CD45RA+) (FIG. 89C), CD8+ T cells (CD45RA–) (FIG. 89D), and CD4+ T cells (CD45RA–) (FIG. 89E) after dosing cynomolgus monkeys with XENP22822.

Figure 90A:
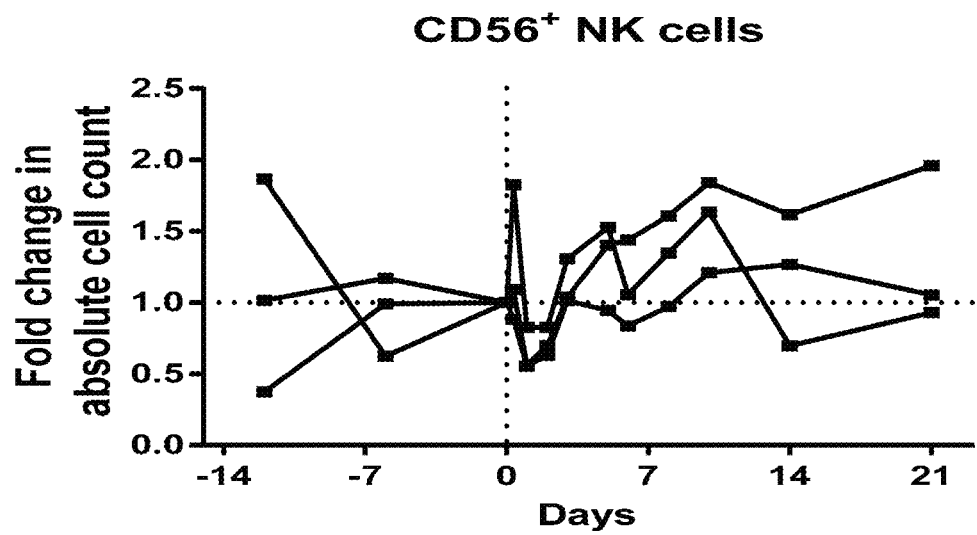
Figure 90B:
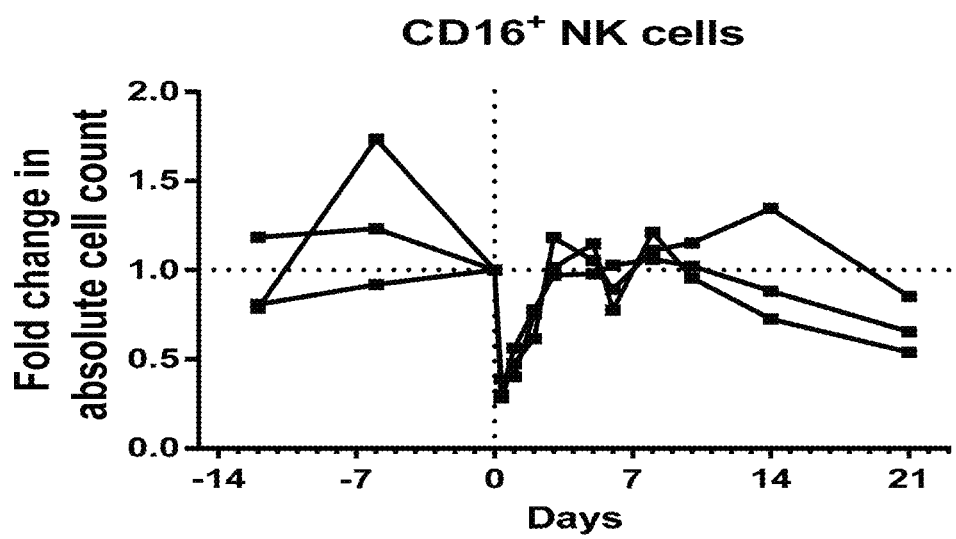
Figure 90C:
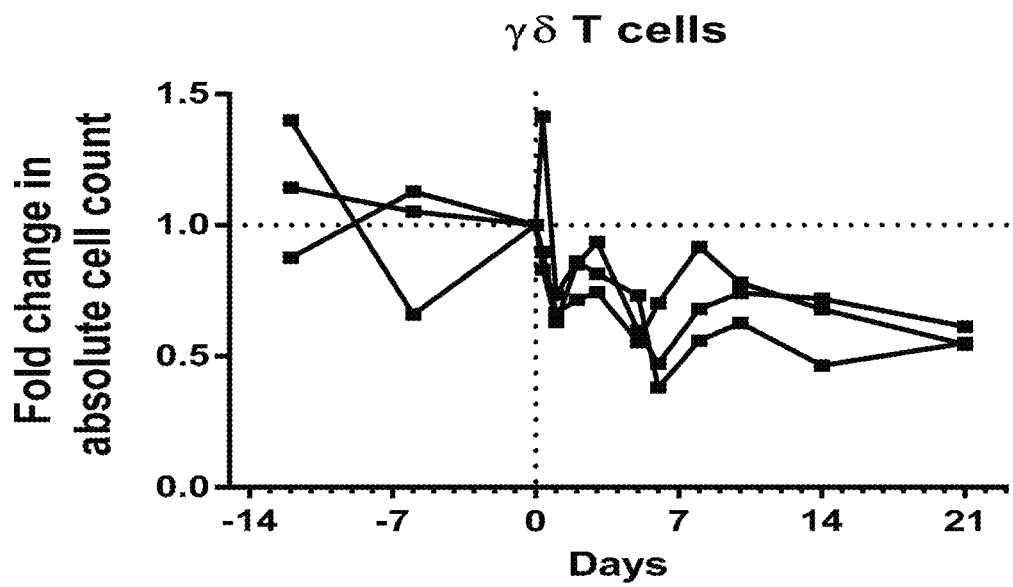
Figure 90D:
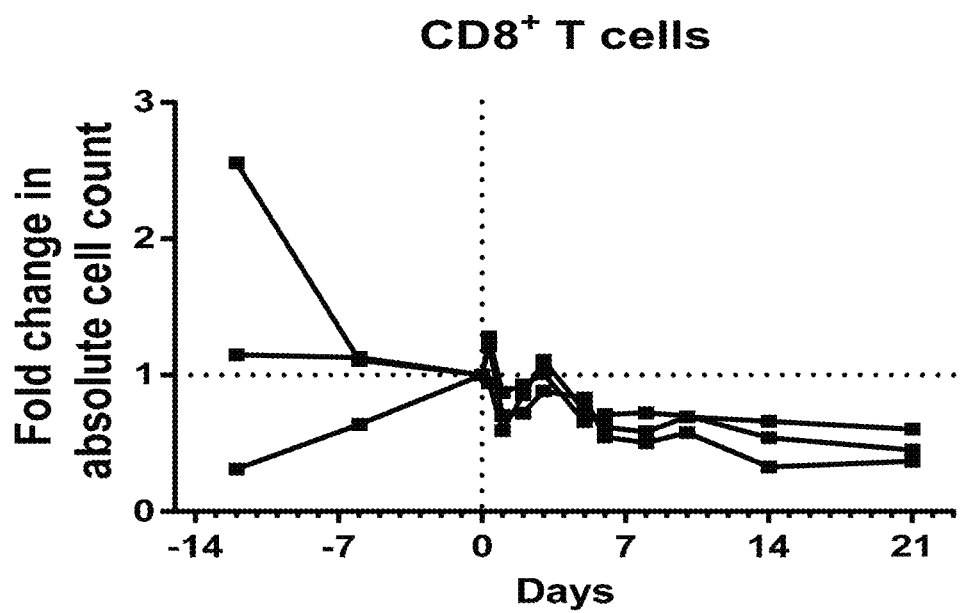
Figure 90E:
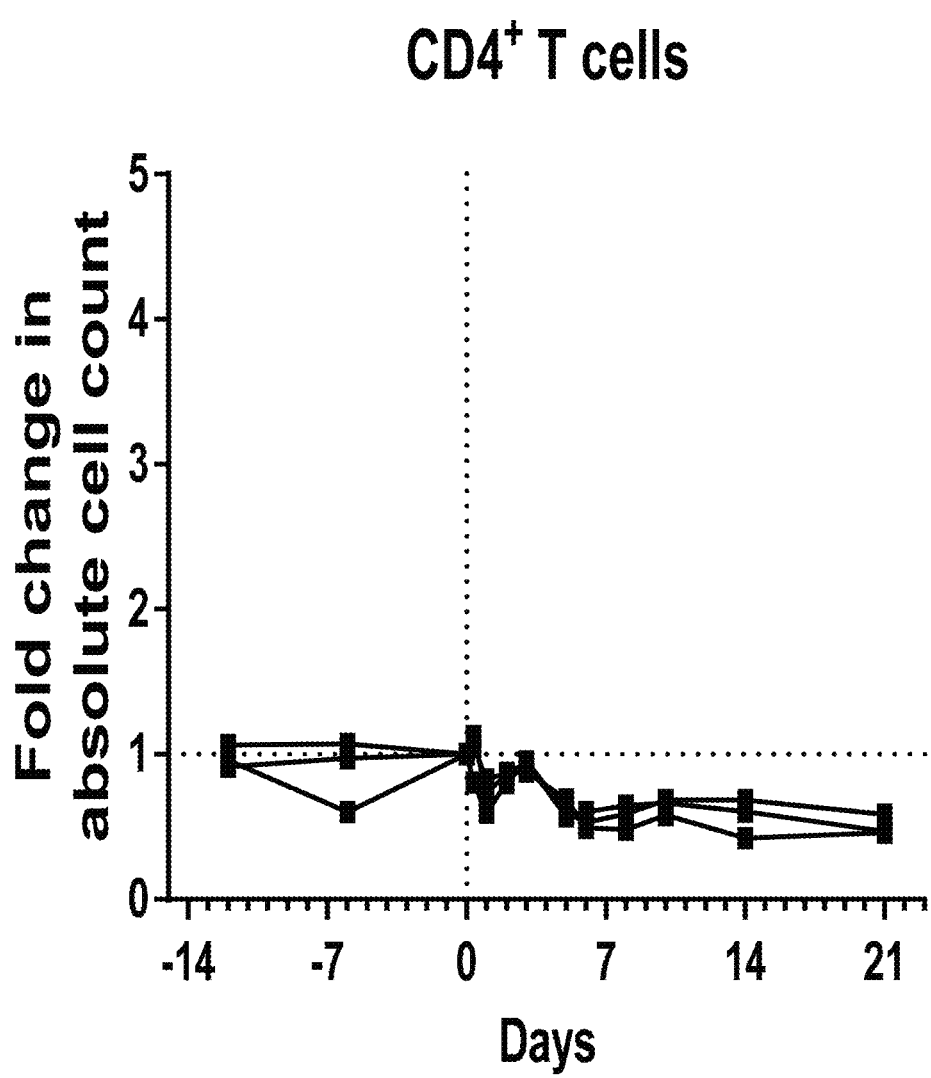
Figure 91A:
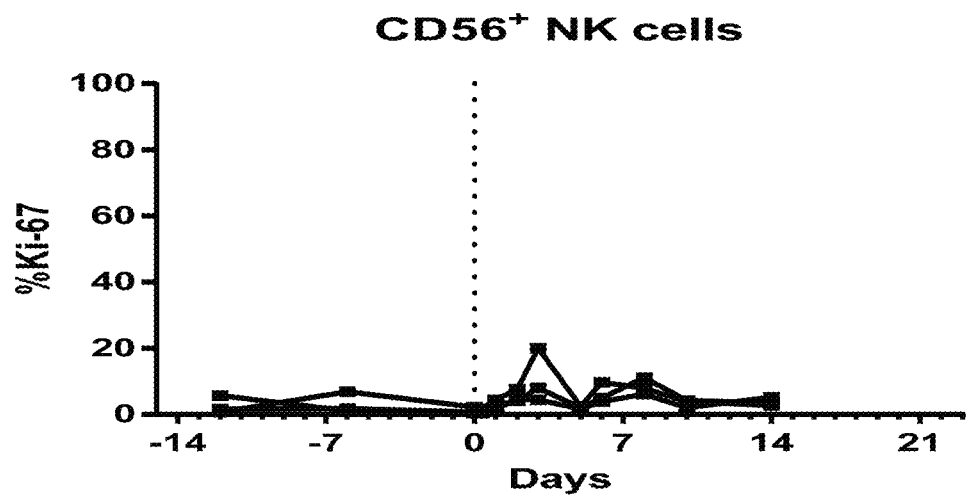
Figure 91B:
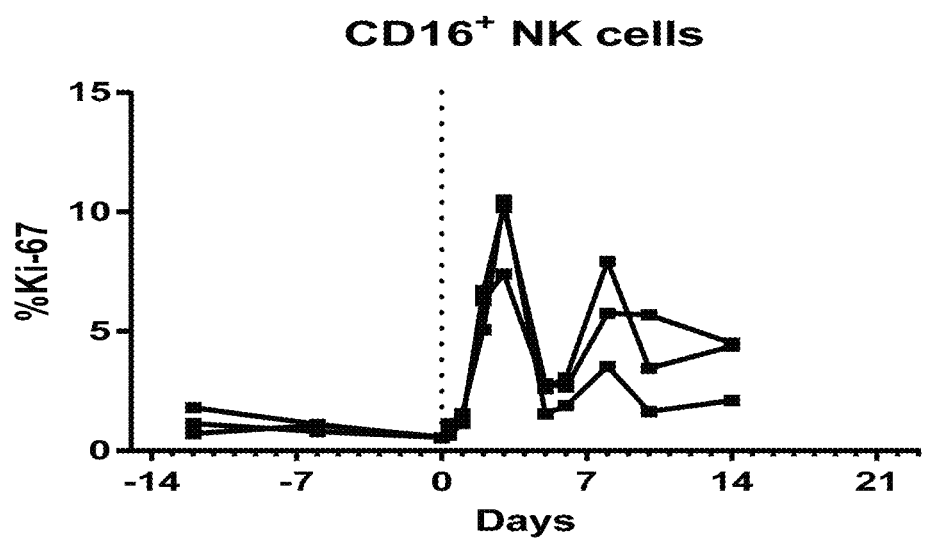
Figure 91C:
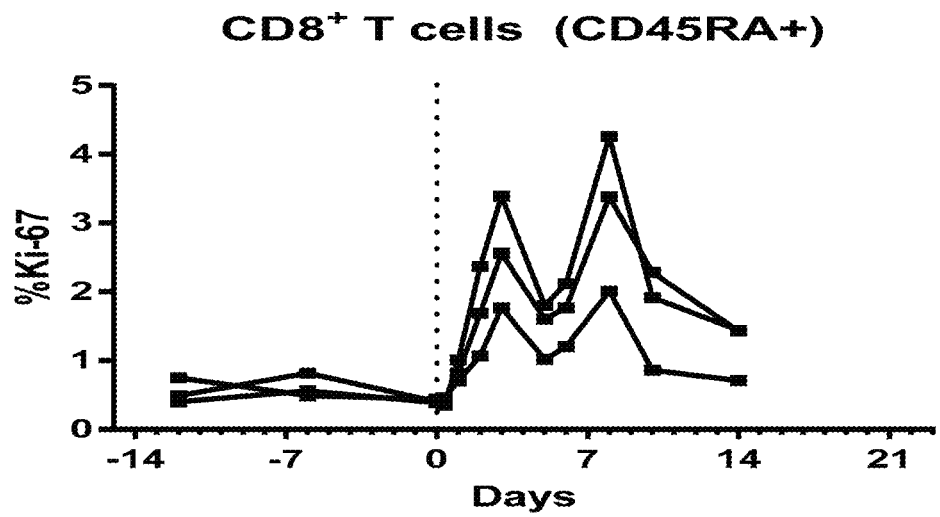
Figure 91D:
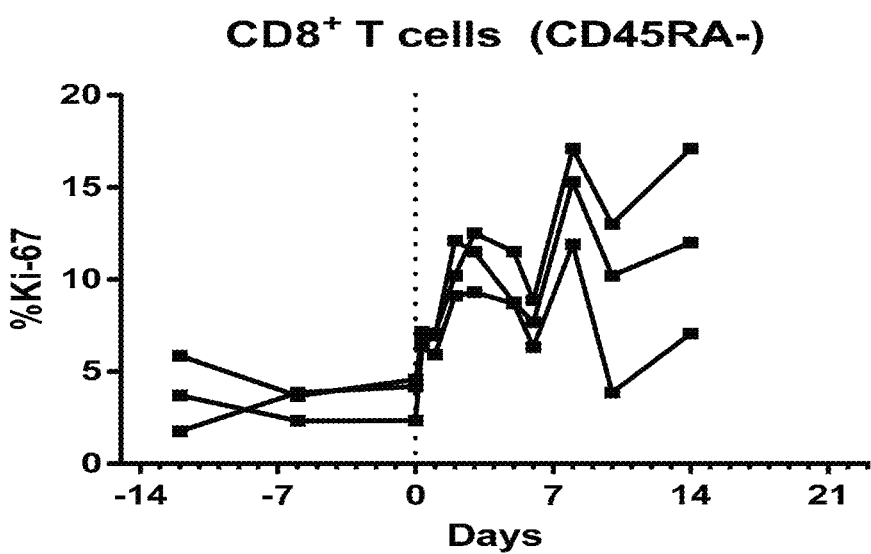
Figure 91E:
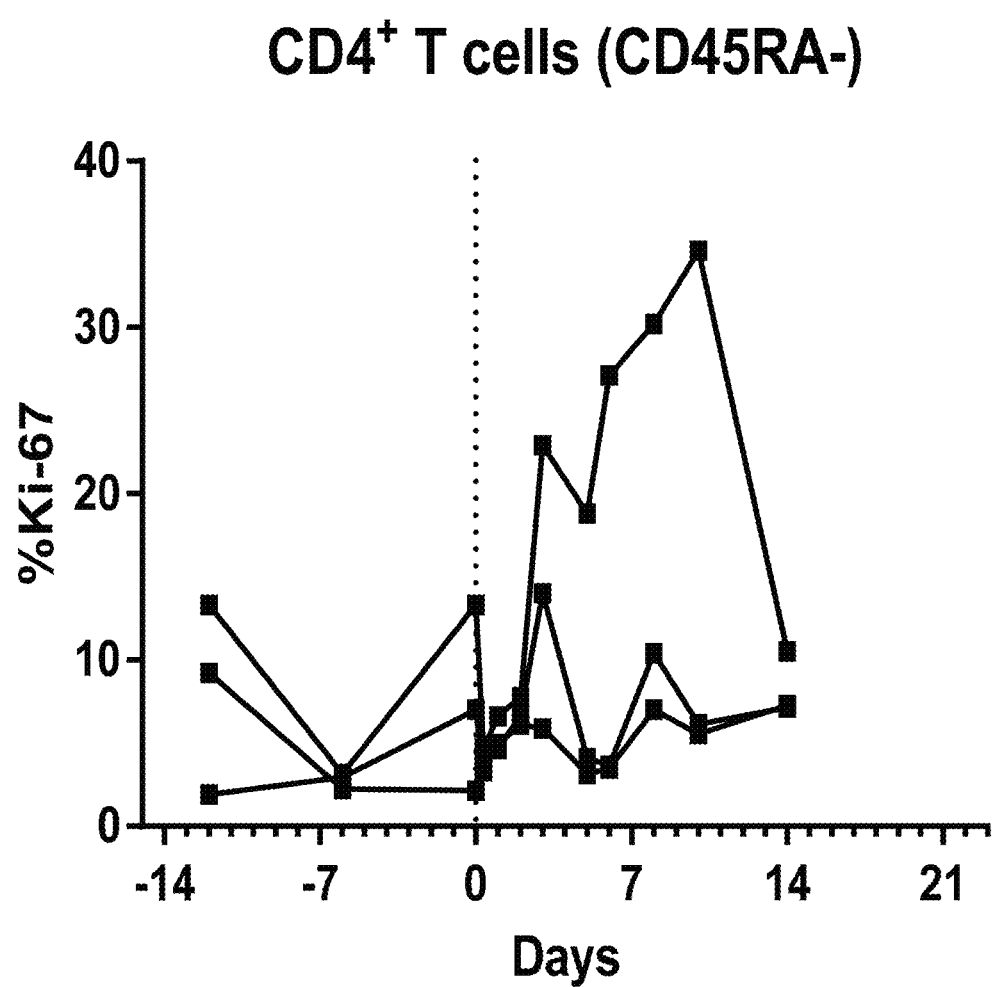

FIGS. 90A-90E depict lymphocyte counts after dosing cynomolgus monkeys with XENP22834. FIGS. 90A-E respectively show the fold change in absolute count of CD56+ NK cells (FIG. 90A), CD16+ NK cells (FIG. 90B), γδ T cells (CD45RA+CD3+CD4−CD8−) (FIG. 90C), CD8+ T cells (FIG. 90D), and CD4+ T cells (FIG. 90E).

FIGS. 91A-91E depict proliferation of CD56+ NK cells (FIG. 91A), CD16+ NK cells (FIG. 91B), CD8+ T cells (CD45RA+) (FIG. 91C), CD8+ T cells (CD45RA−) (FIG. 91D), and CD4+ T cells (CD45RA−) (FIG. 91E) after dosing cynomolgus monkeys with XENP22834.

Figure 92A:
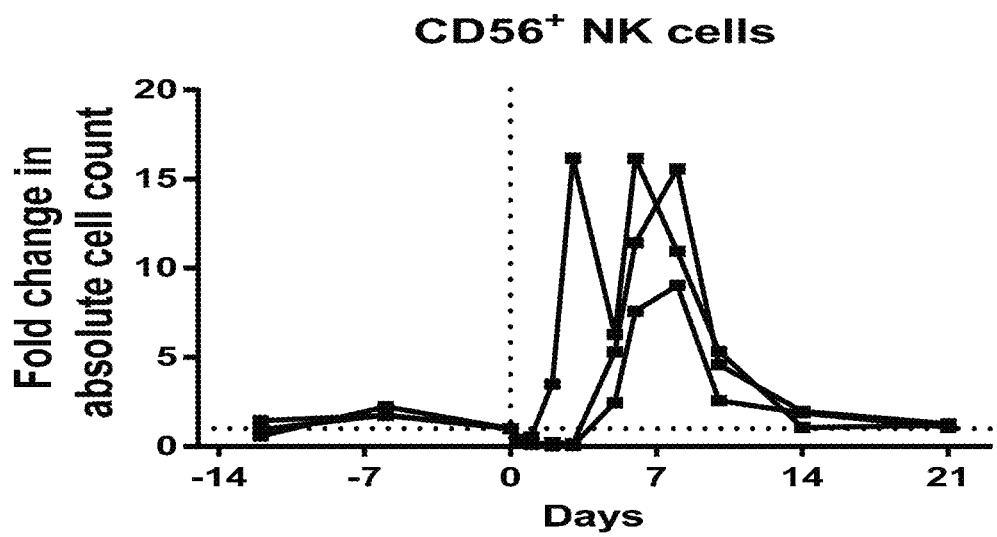
Figure 92B:
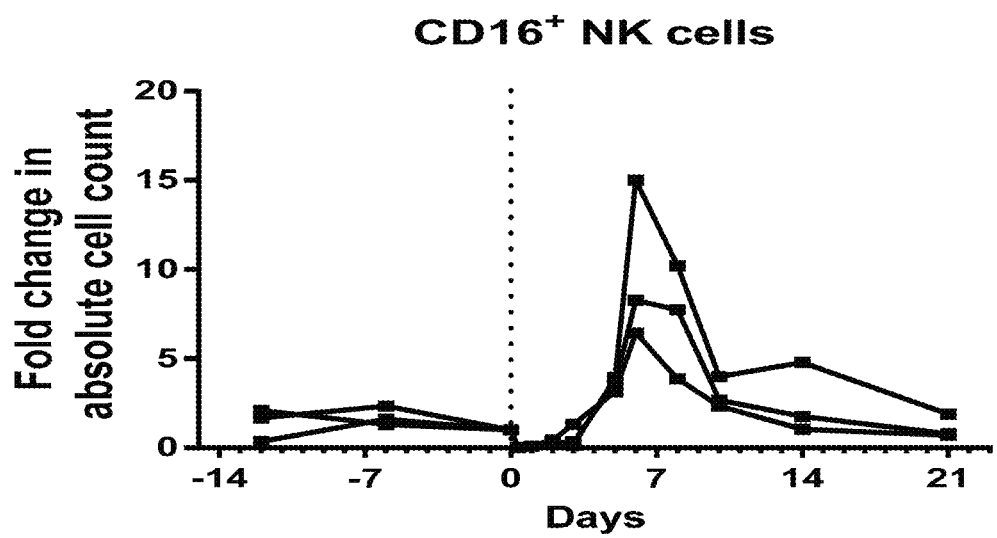
Figure 92C:
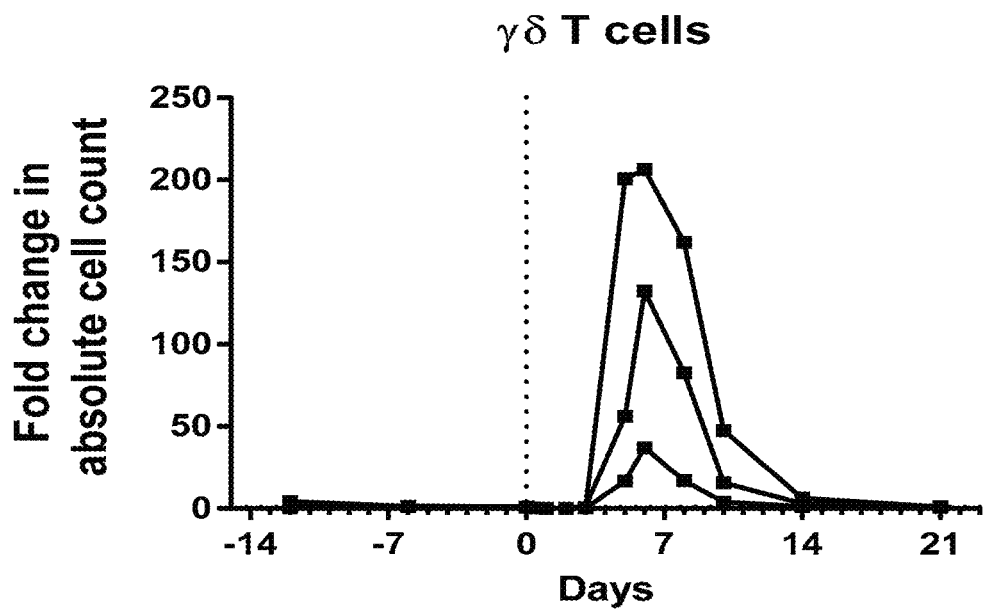
Figure 92D:
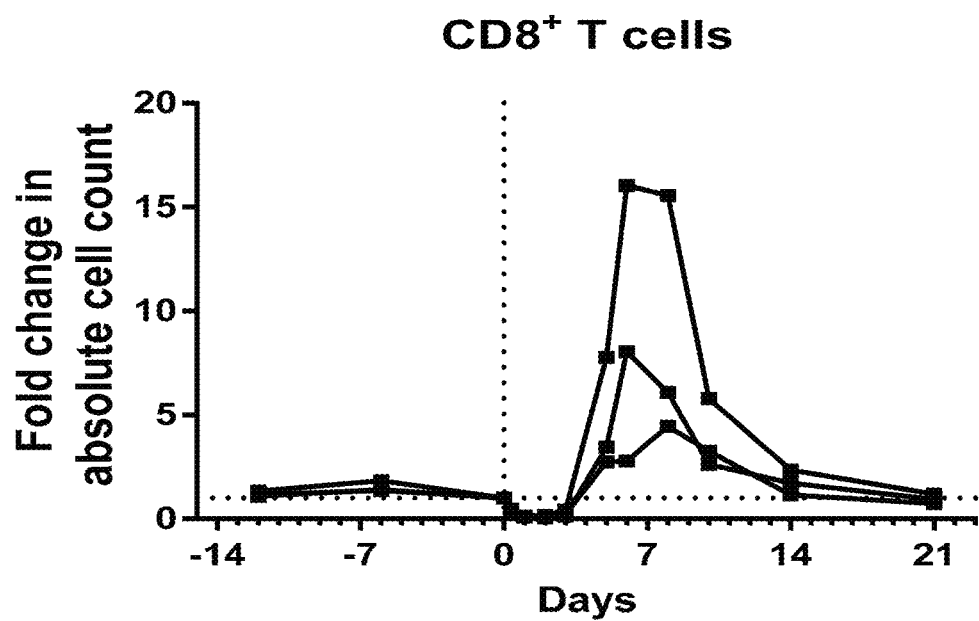
Figure 92E:
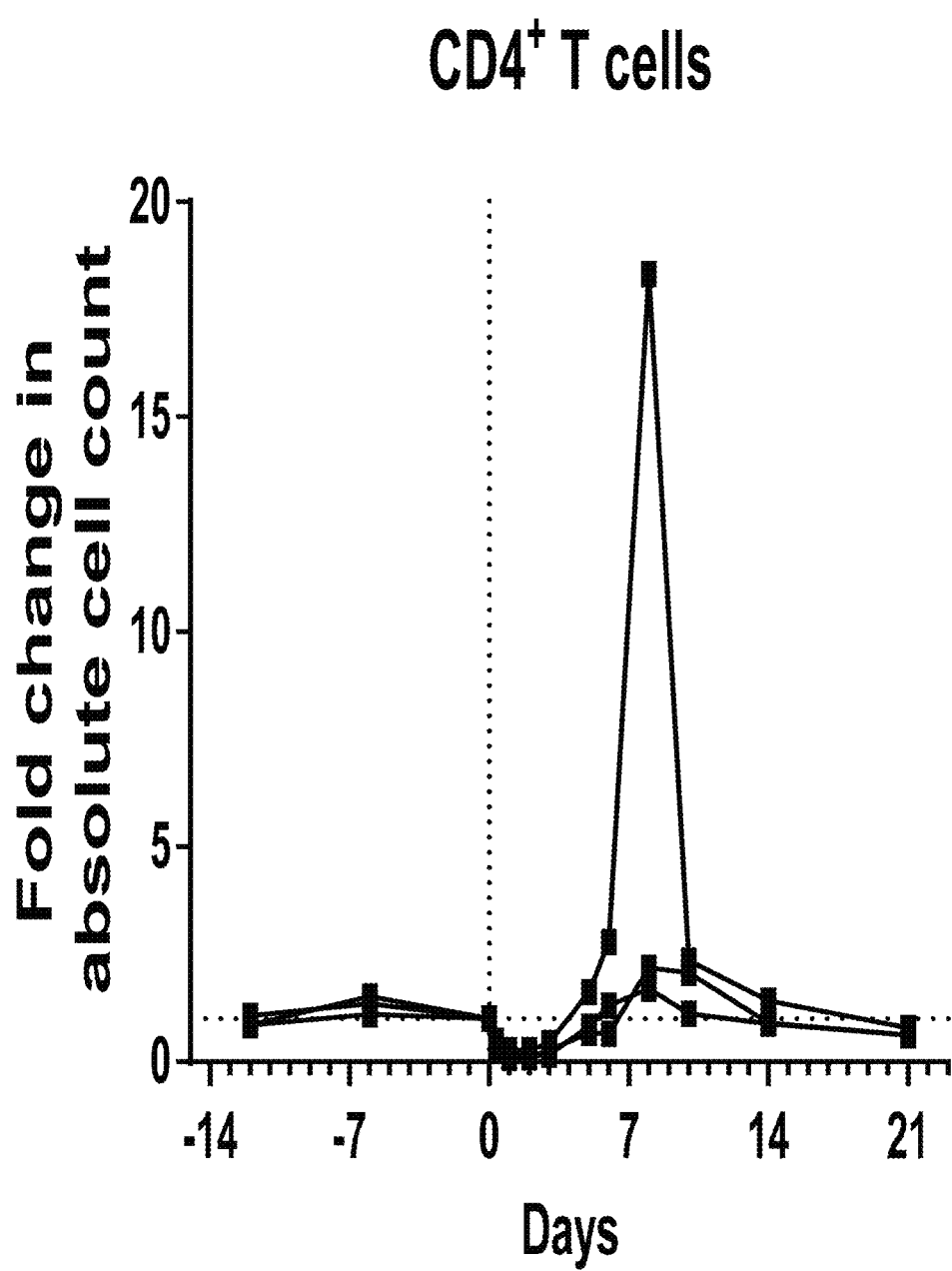
Figure 93A:
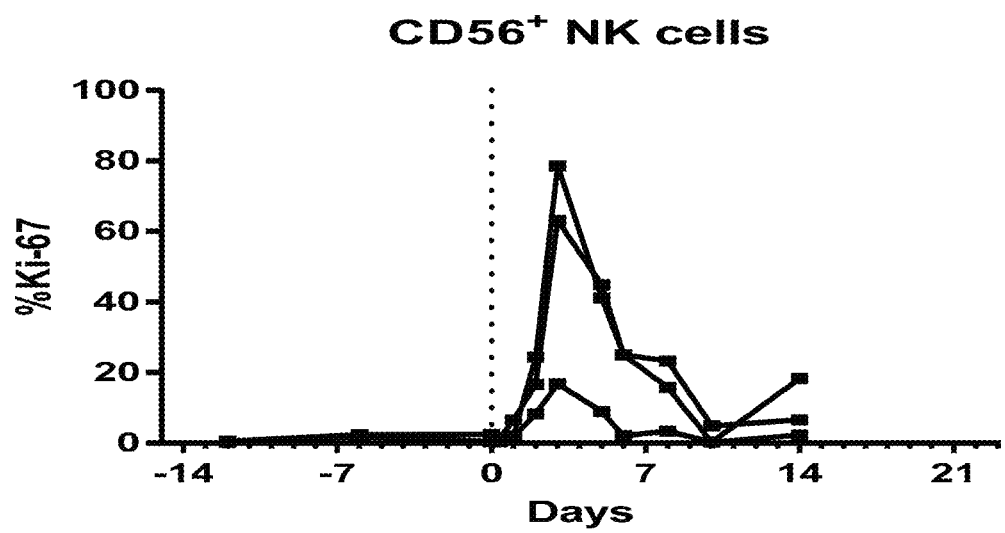
Figure 93B:
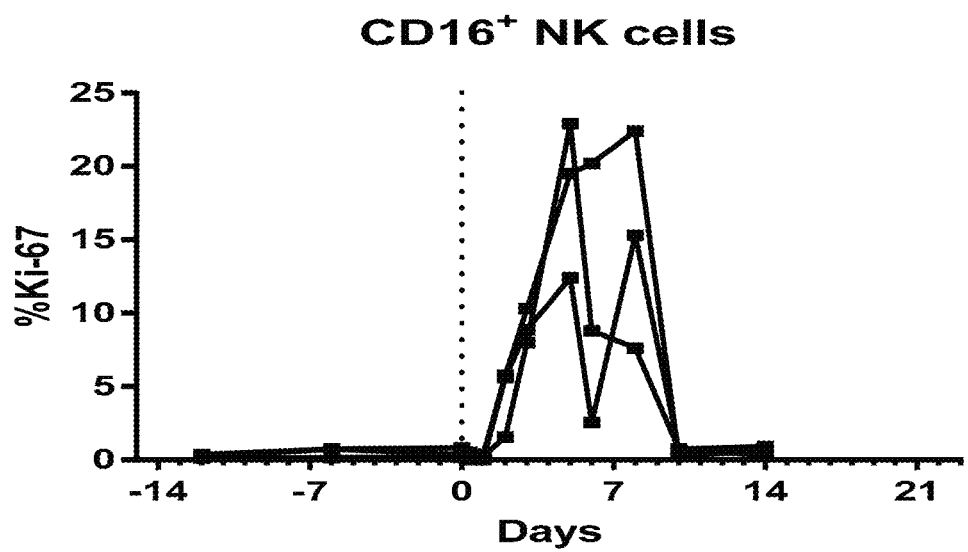
Figure 93C:
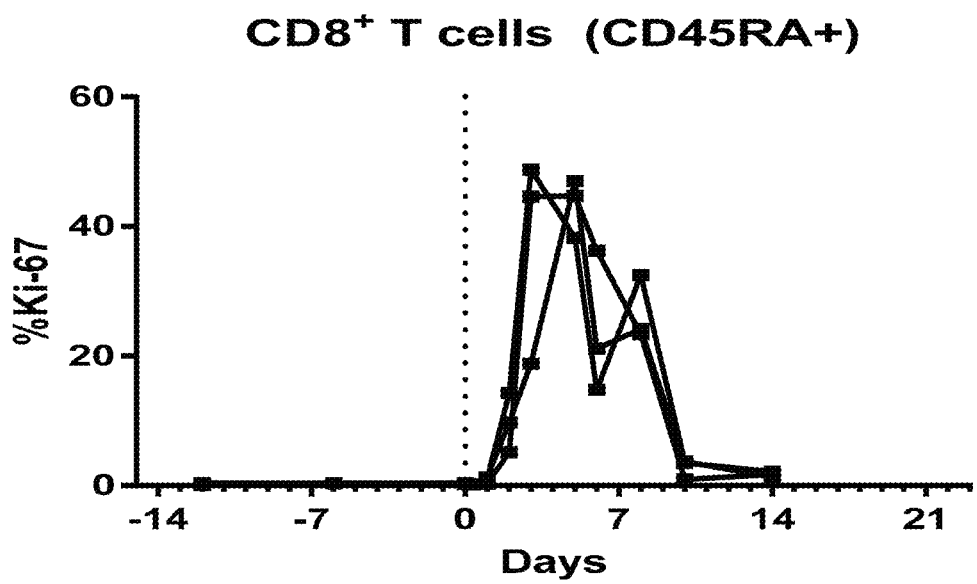
Figure 93D:
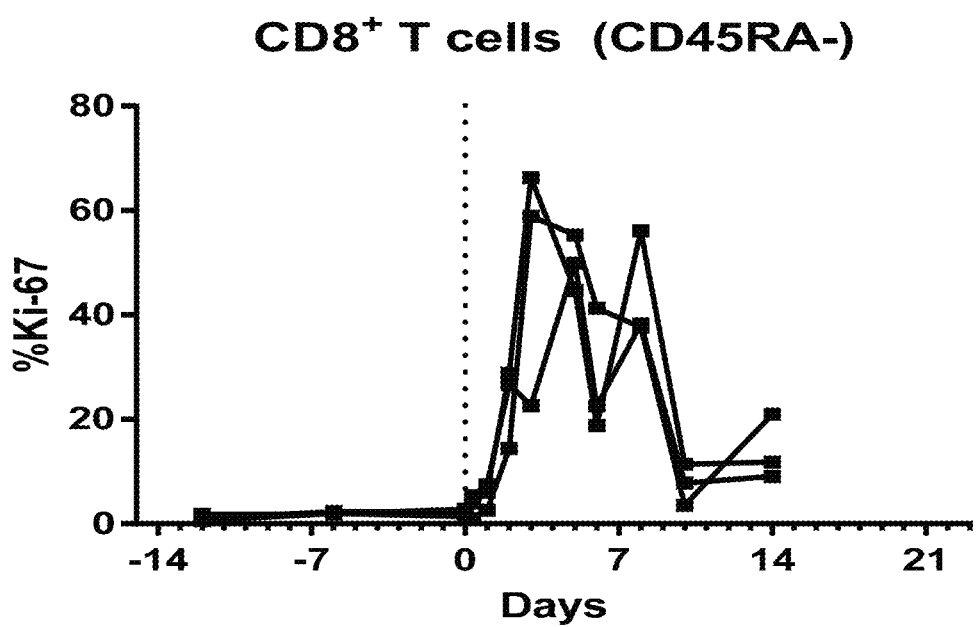
Figure 93E:
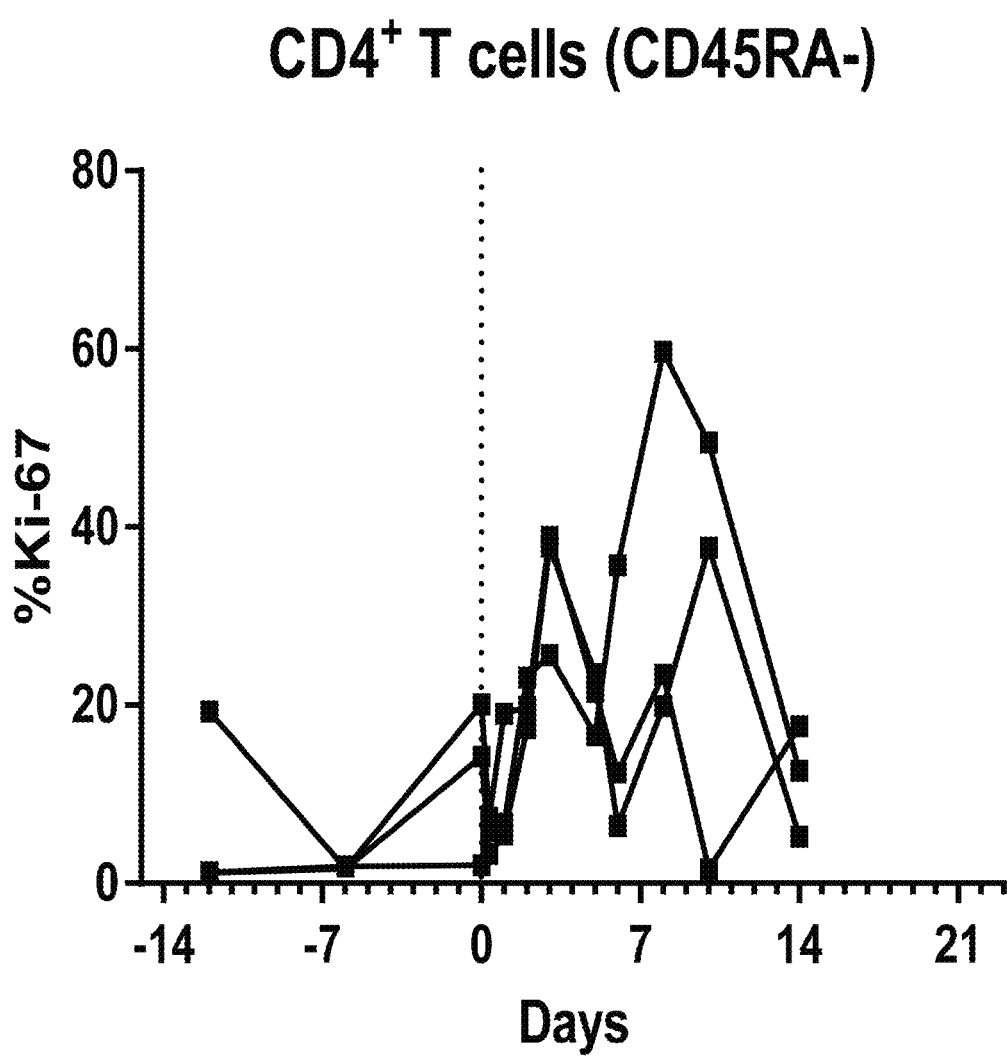

FIGS. 92A-92E depict lymphocyte counts after dosing cynomolgus monkeys with XENP23343. FIGS. 92A-E respectively show the fold change in absolute count of CD56+ NK cells (FIG. 92A), CD16+ NK cells (FIG. 92B), γδ T cells (CD45RA+CD3+CD4−CD8−) (FIG. 92C), CD8+ T cells (FIG. 92D), and CD4+ T cells (FIG. 92E).

FIGS. 93A-93E depict proliferation of CD56+ NK cells (FIG. 93A), CD16+ NK cells (FIG. 93B), CD8+ T cells (CD45RA+) (FIG. 93C), CD8+ T cells (CD45RA−) (FIG. 93D), and CD4+ T cells (CD45RA−) (FIG. 93E) after dosing cynomolgus monkeys with XENP23343.

FIGS. 94A-94D depict sequences of XENP23343, XENP23504, XENP24113, XENP24301, XENP24306, and XENP24341, illustrative IL-15/Rα-Fc fusion proteins of the "IL-15/Rα-heteroFc" format with M428L/N434S substitutions. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions. FIG. 94D depicts sequences of XENP25938, an illustrative IL-15/Rα-Fc fusion protein of the "scIL-15/Rα-Fc" format with M428L/N434S substitutions.

FIG. 95 depicts sequences of XENP24383, an illustrative IL-15/Rα-Fc fusion protein of the "ncIL-15/Rα-Fc" format with M428L/N434S substitutions. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

FIG. 96 depicts sequences of XENP24346 and XENP24351, illustrative IL-15/Rα-Fc fusion proteins of the "bivalent ncIL-15/Rα-Fc" format with M428L/N434S substitutions. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

Figure 97A:
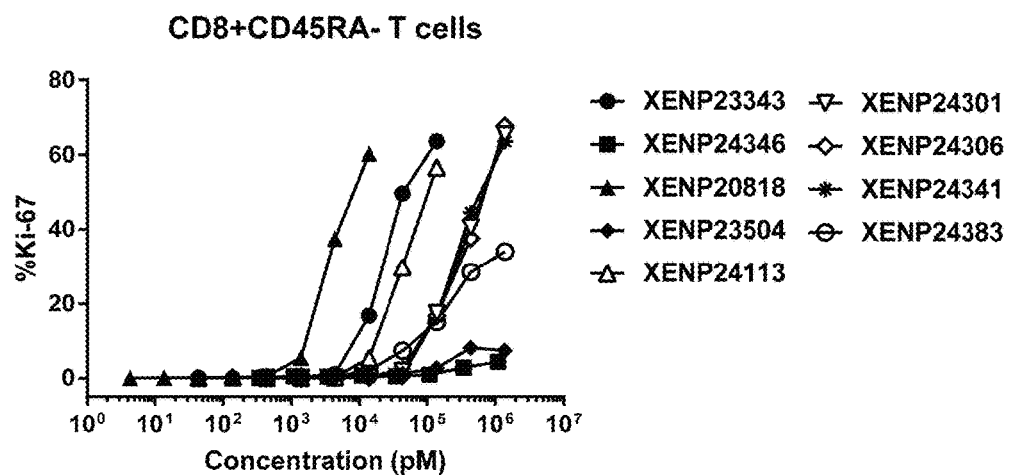
Figure 97B:
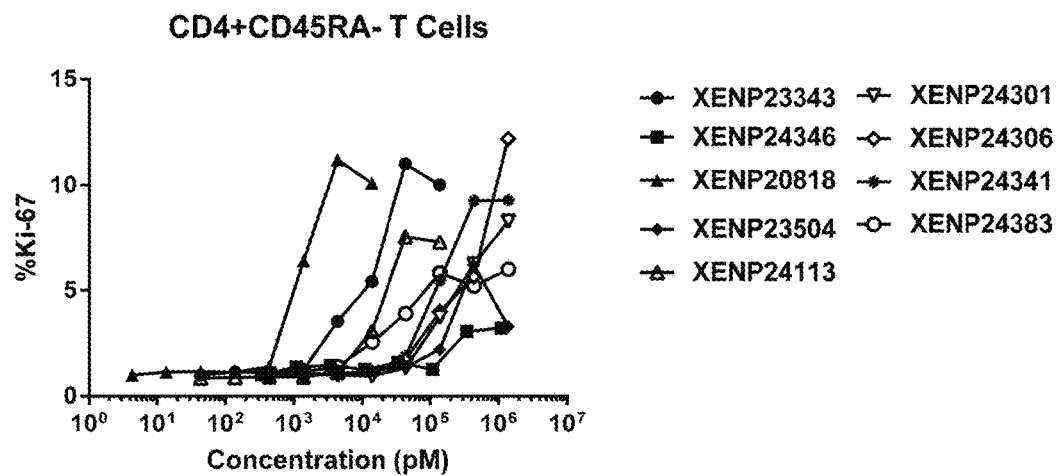
Figure 97C:
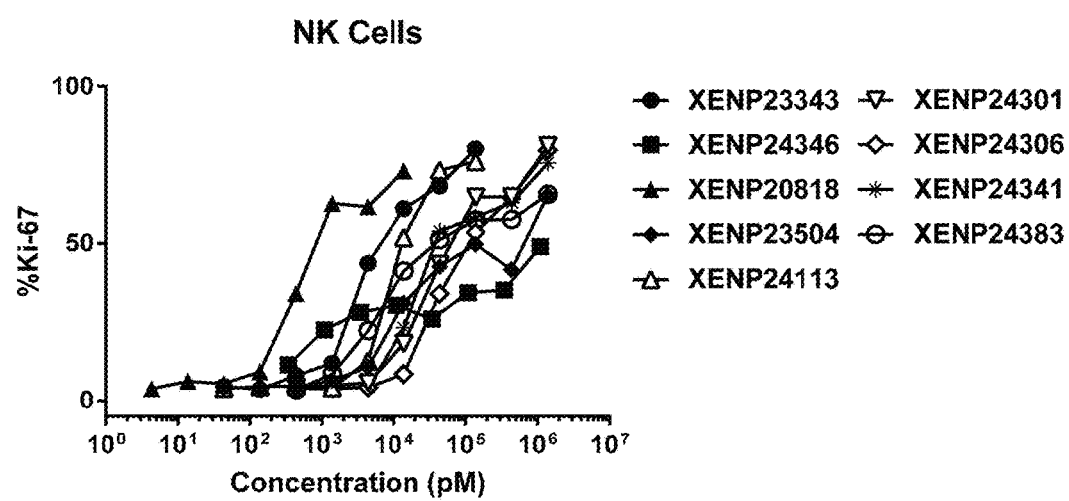

FIGS. 97A-97C depict the percentage of Ki67 expression on (A) human CD8+ T cells, (B) human CD4+ T cells and (C) human NK cells following treatment with IL-15/Rα variants with M428L/N434S Fc mutations.

Figure 98A:
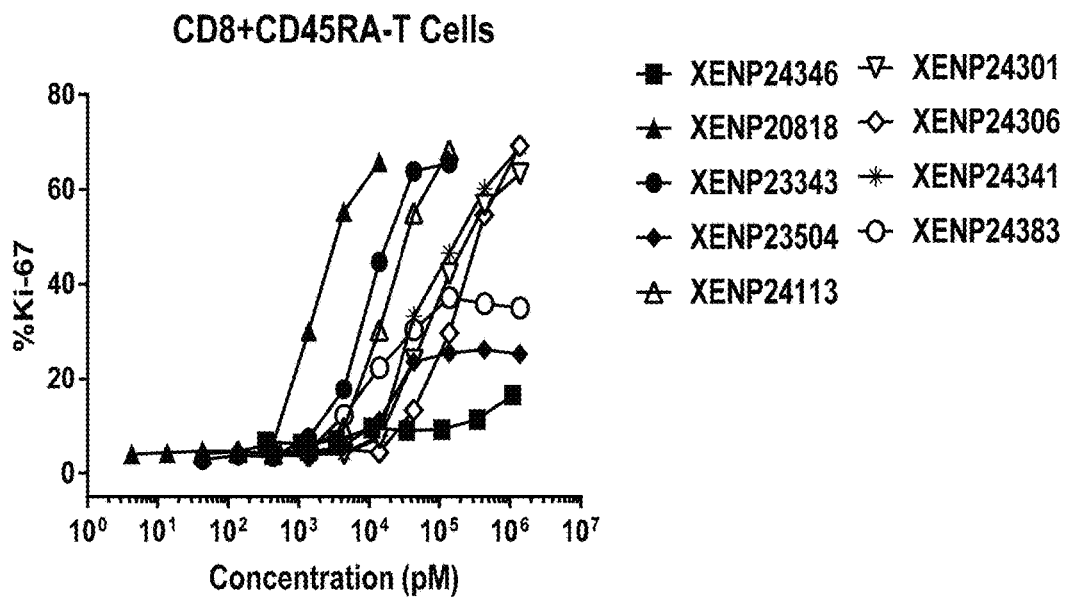
Figure 98B:
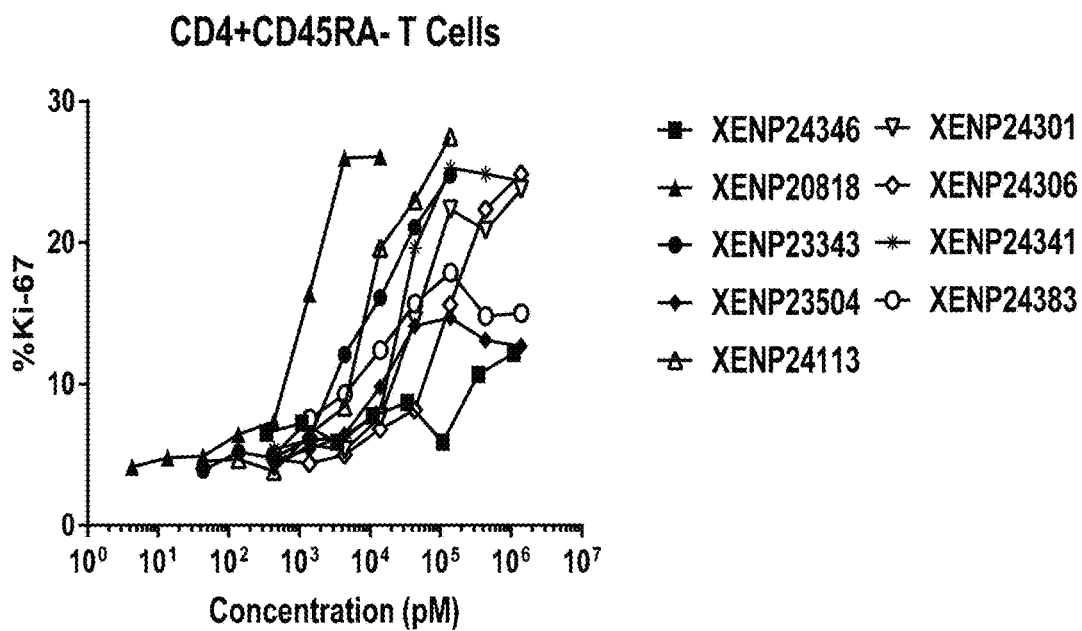
Figure 98C:
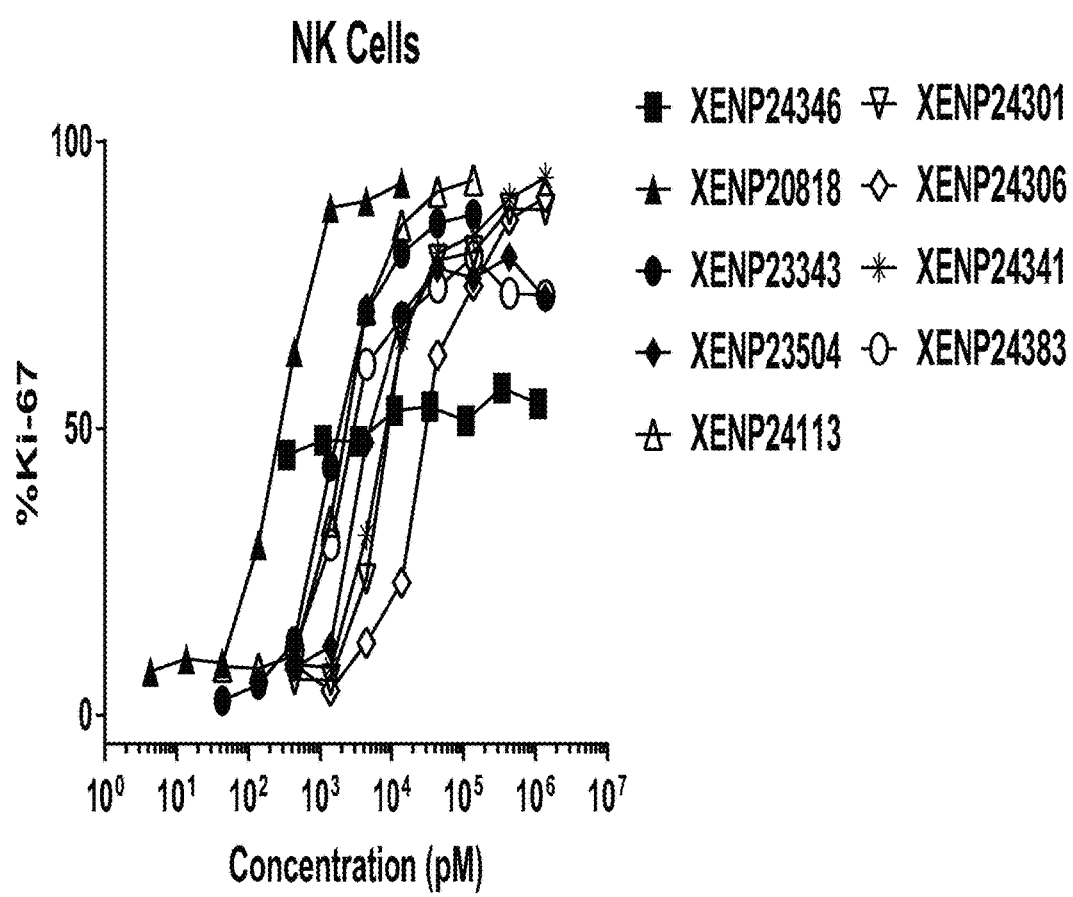

FIGS. 98A-98C depict the percentage of Ki67 expression on (A) cyno CD8+ T cells, (B) cyno CD4+ T cells and (C) cyno NK cells following treatment with IL-15/Rα variants with M428L/N434S Fc mutations.

Figure 99A:
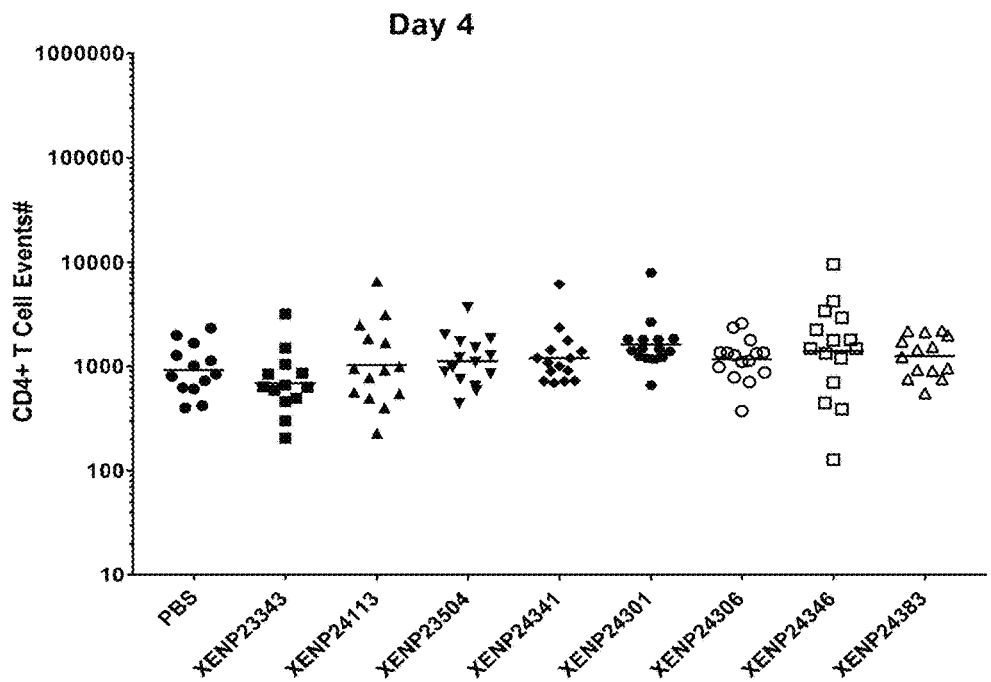
Figure 99B:
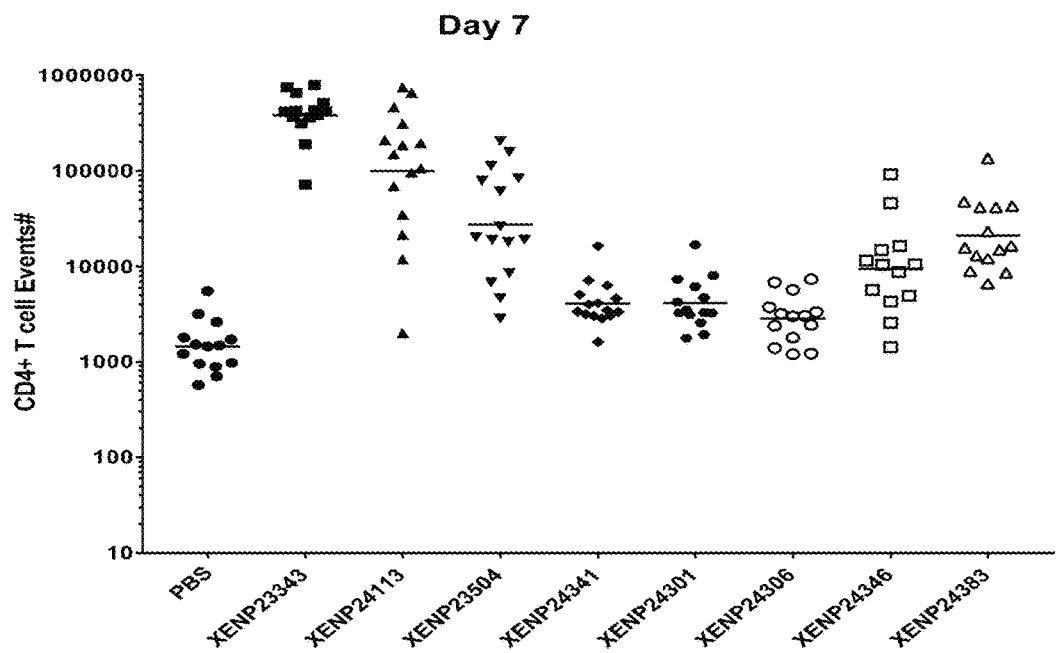
Figure 99C:
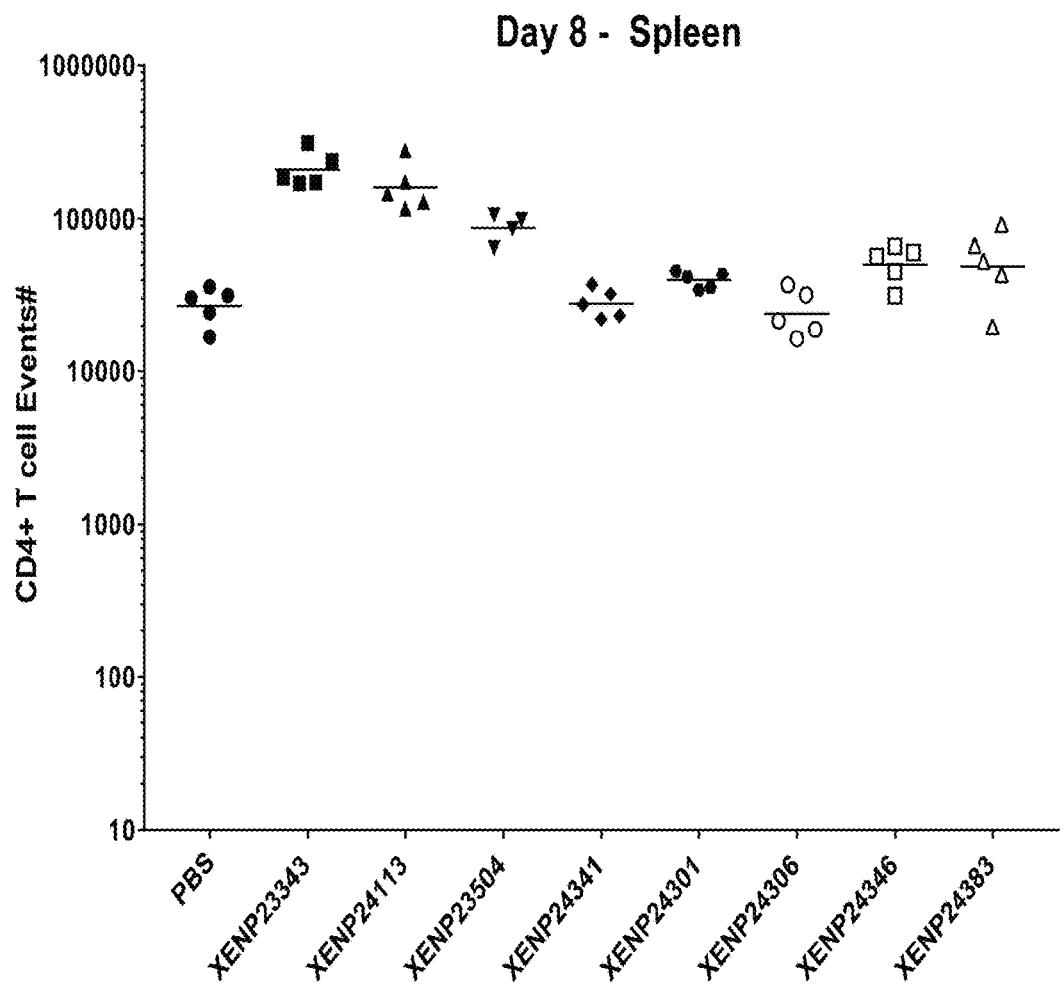

FIGS. 99A-99C depict CD4+ T cell count on (A) Day 4 and (B) Day 7 in whole blood and (C) Day 8 in spleen of huPBMC engrafted mice following treatment with additional variant IL-15/Rα-Fc fusion proteins.

Figure 100A:
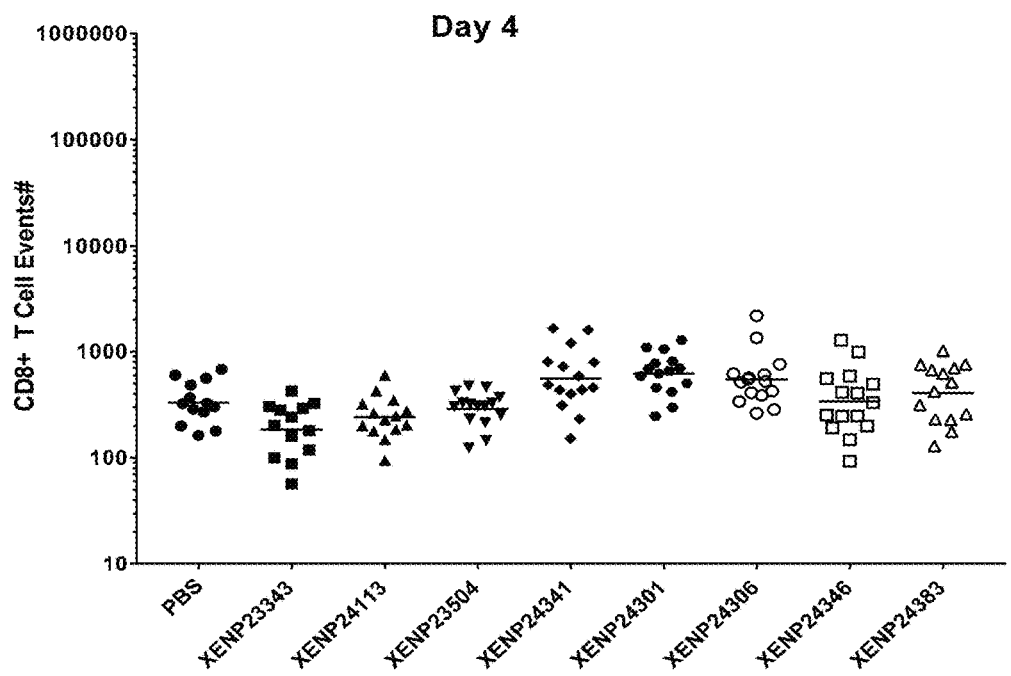
Figure 100B:
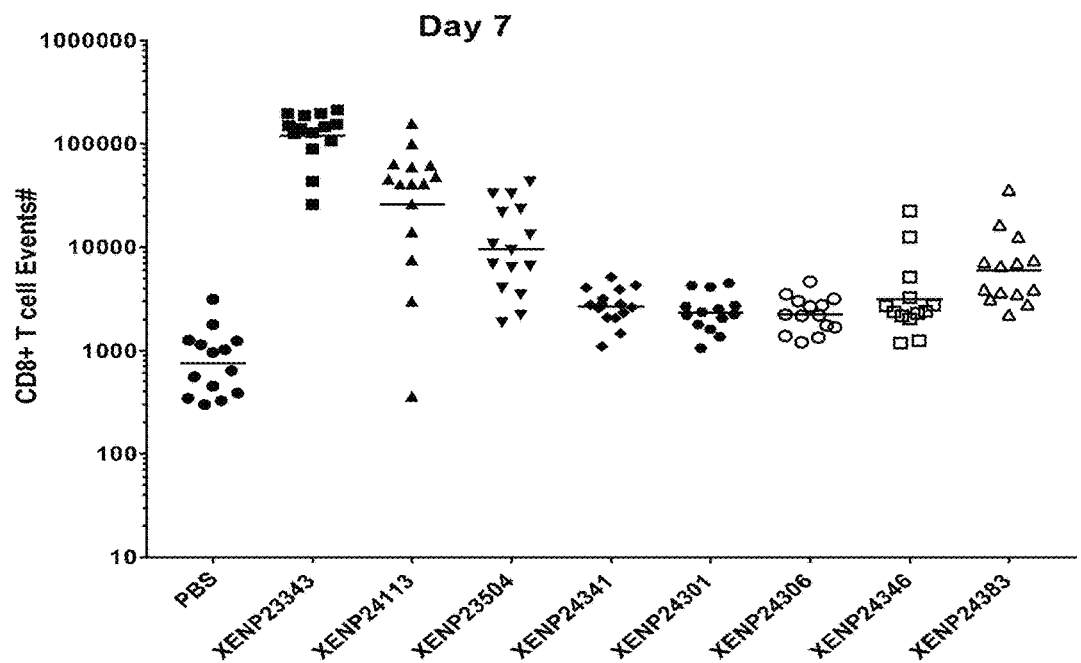
Figure 100C:
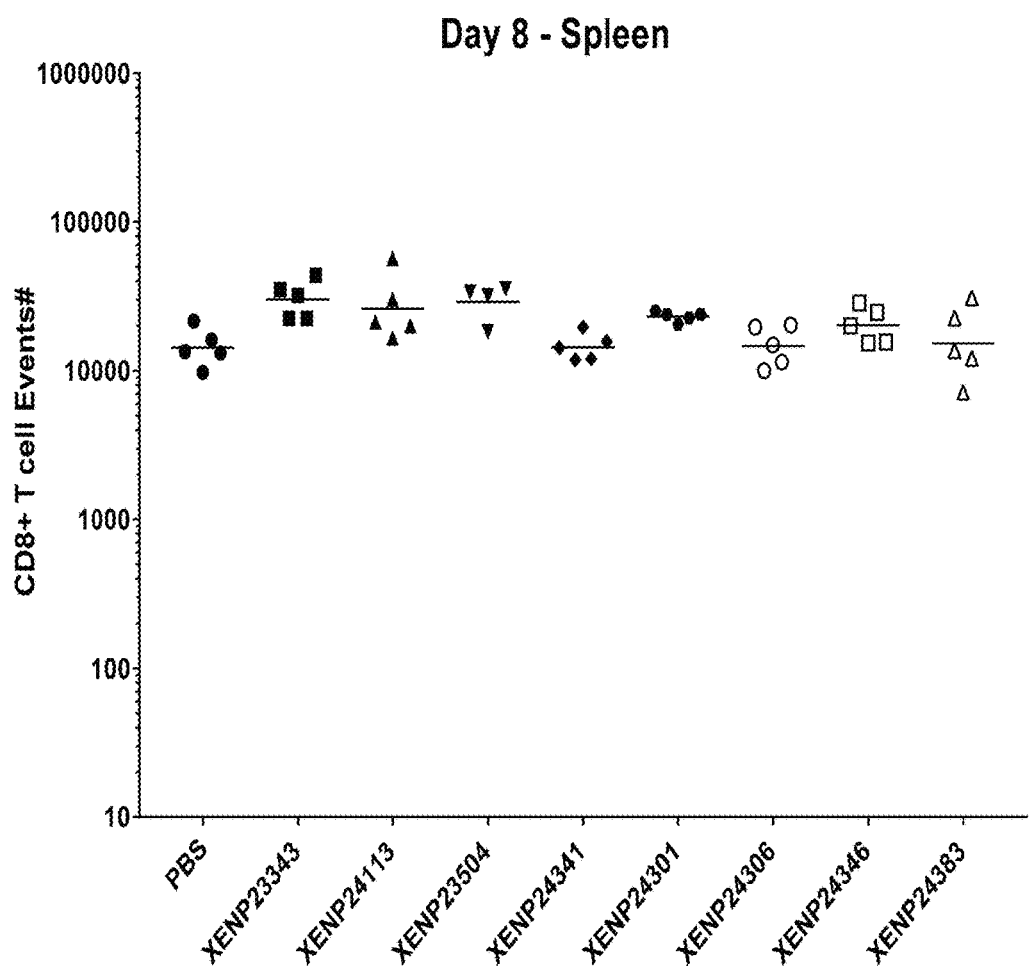

FIGS. 100A-100C depict CD8+ T cell count on (A) Day 4 and (B) Day 7 in whole blood and (C) Day 8 in spleen of huPBMC engrafted mice following treatment with additional variant IL-15/Rα-Fc fusion proteins.

Figure 101A:
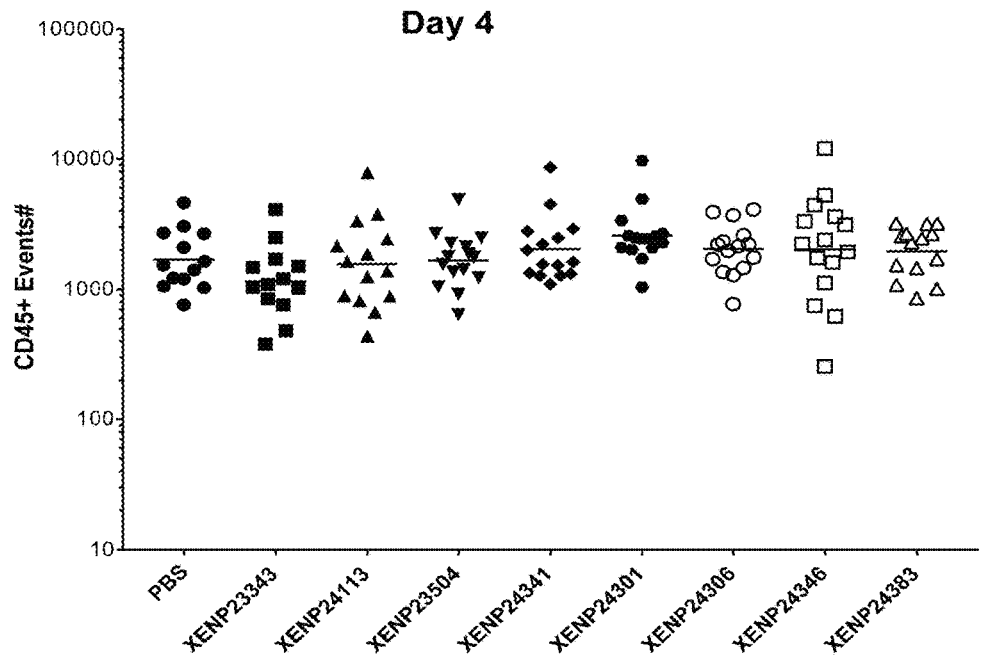
Figure 101B:
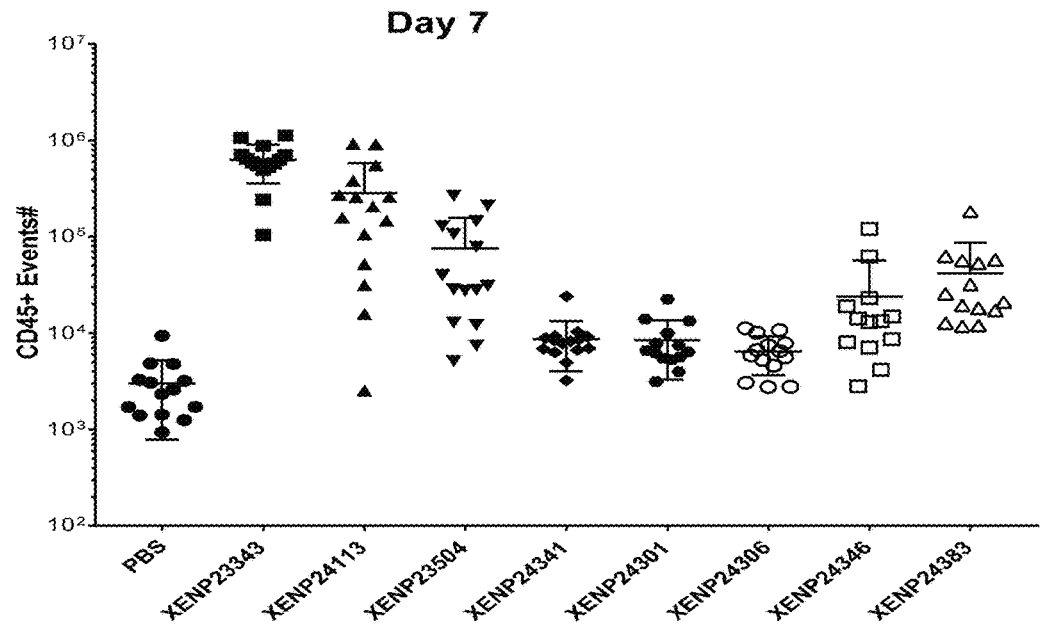
Figure 101C:
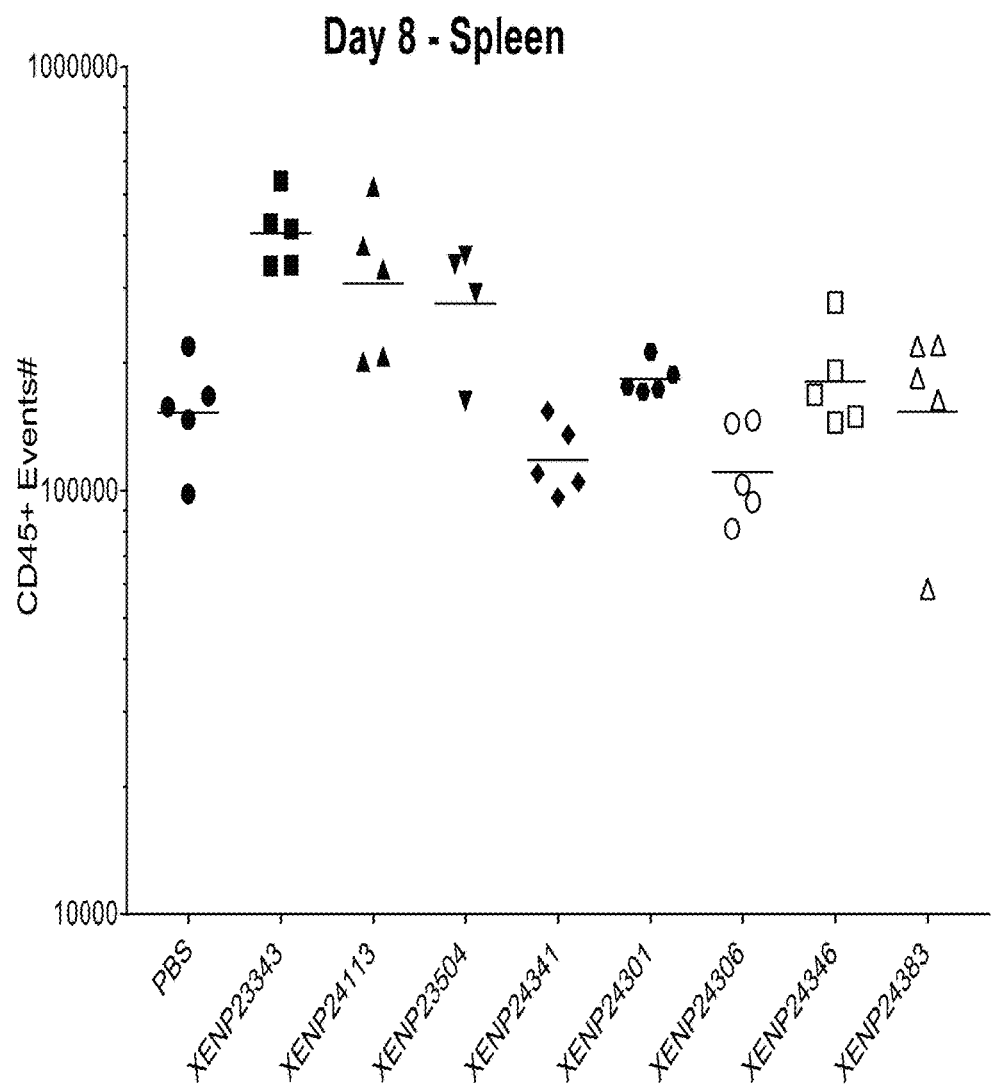

FIGS. 101A-101C depicts CD8+ T cell count on (A) Day 4 and (B) Day 7 in whole blood and (C) Day 8 in spleen of huPBMC engrafted mice following treatment with additional variant IL-15/Rα-Fc fusion proteins.

FIGS. 102A-102F depict the body weight as a percentage of initial body weight of huPBMC engrafted mice on Days (A) −2, (B) 1, (C) 5, (D) 8, and (E) 11 following treatment with additional IL-15/Rα variants. Each point represents a single NSG mouse.

Figure 102A:
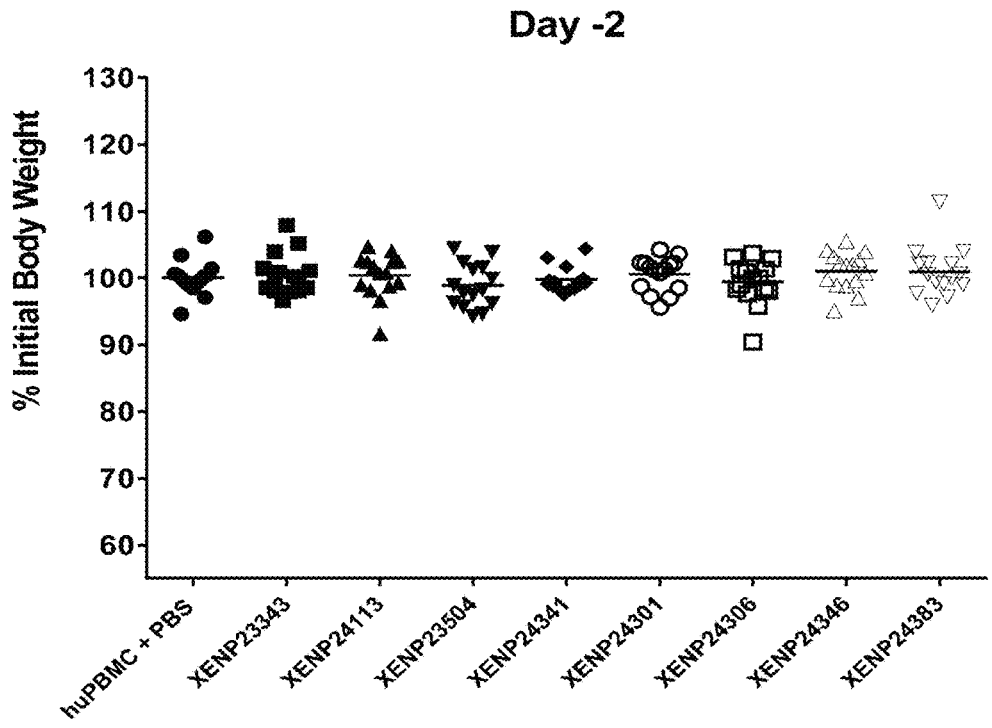
Figure 102B:
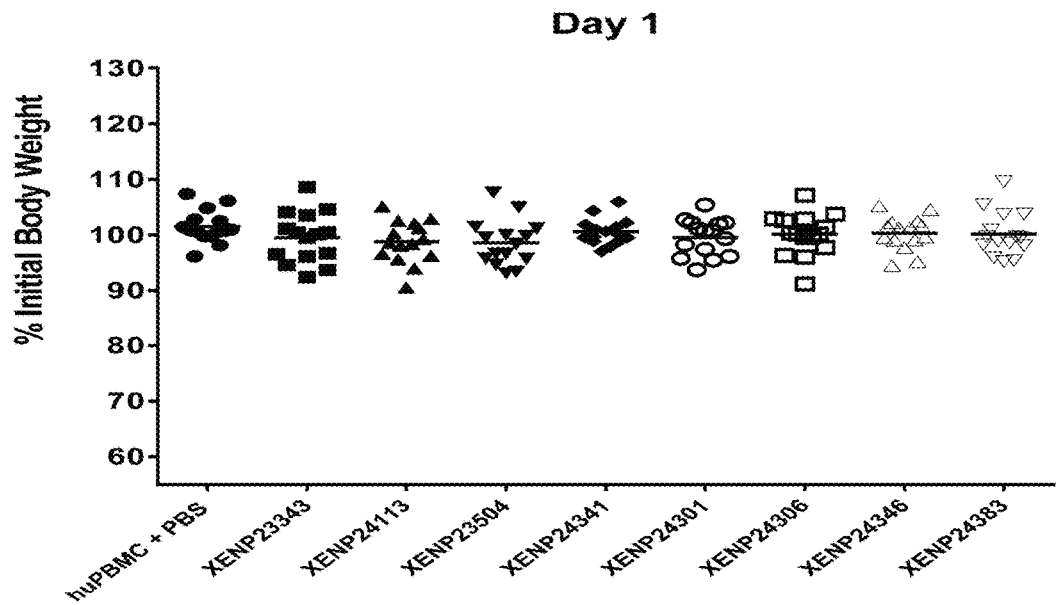
Figure 102C:
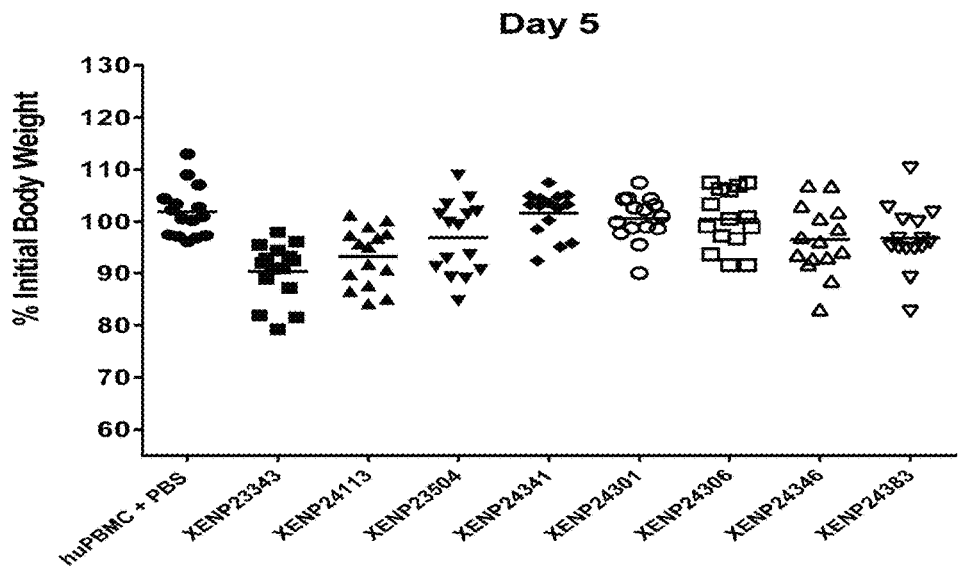
Figure 102D:
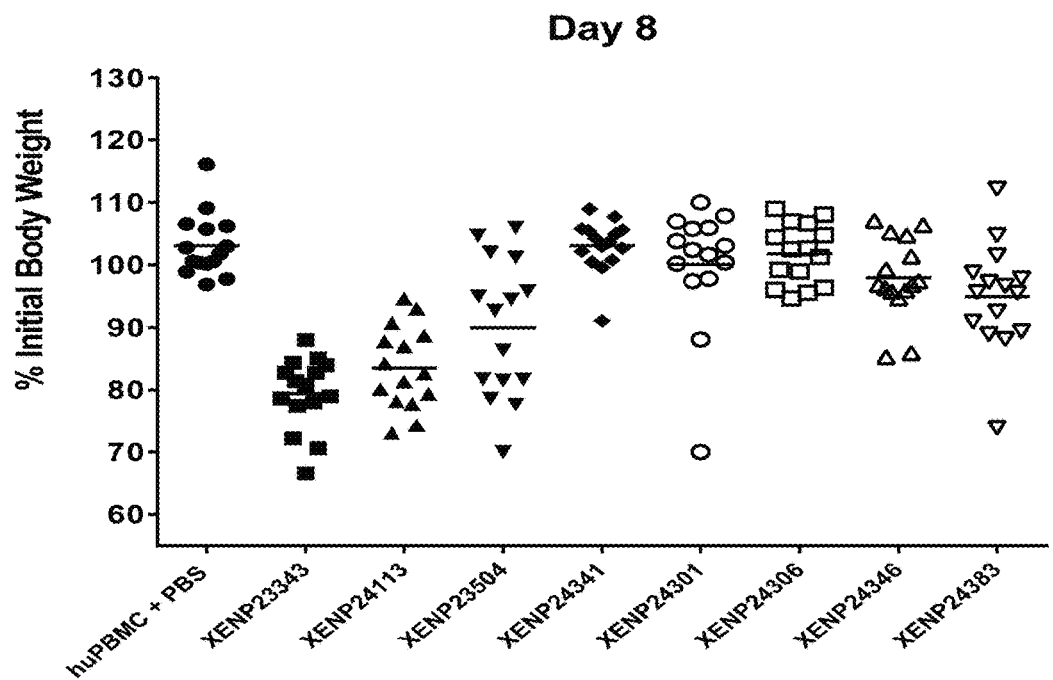
Figure 102E:
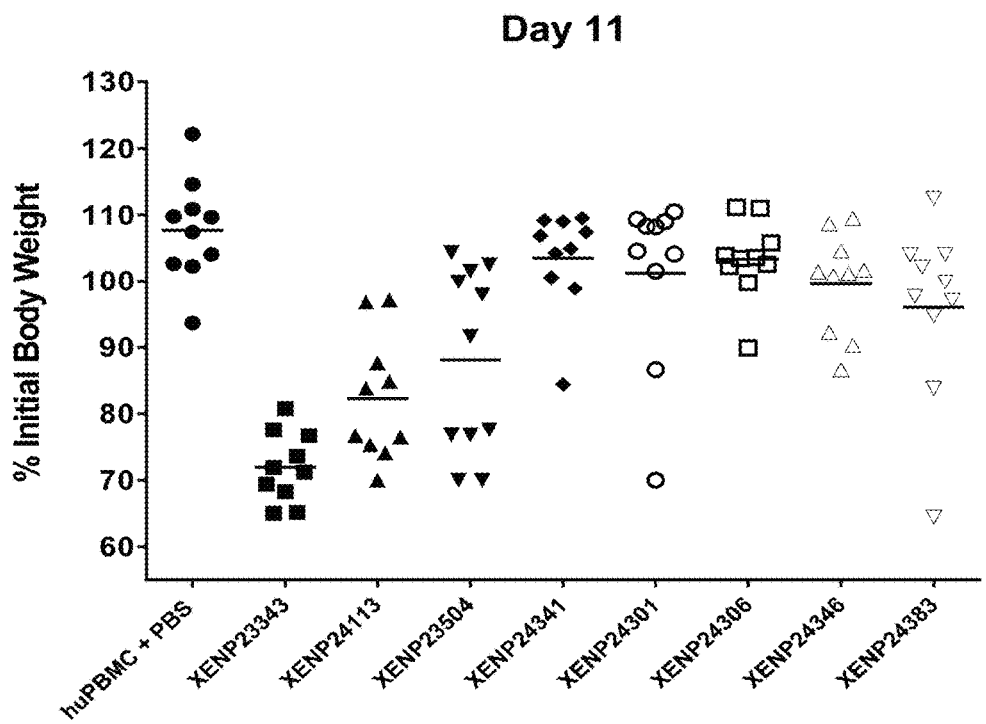
Figure 102F:
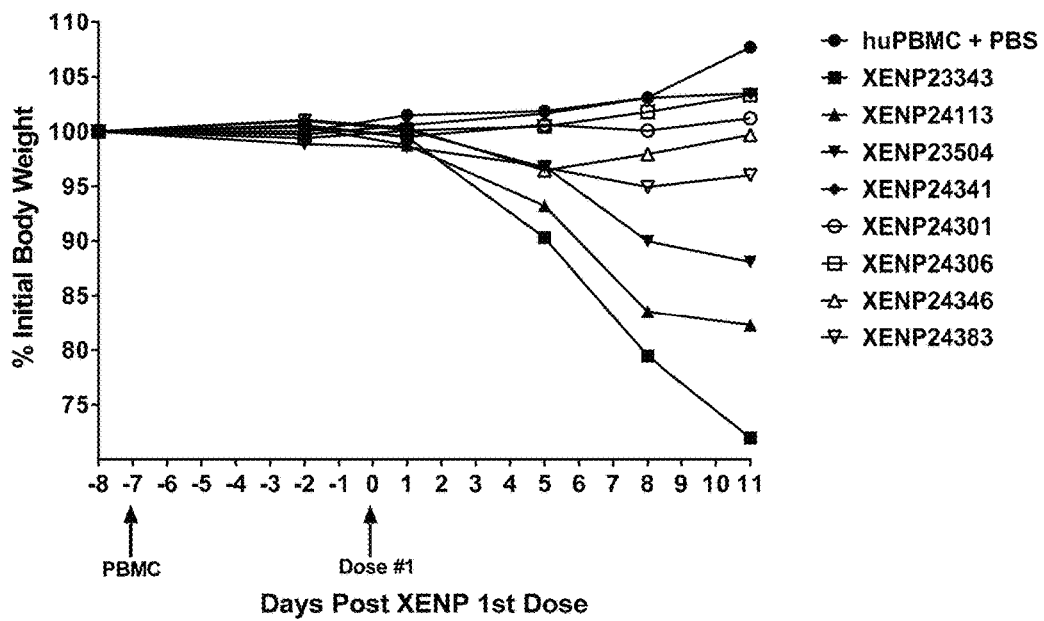

FIG. 102F depicts a time-course of body weight in huPBMC engrafted mice following treatment with the IL-15/Rα variants.

Figure 103A:
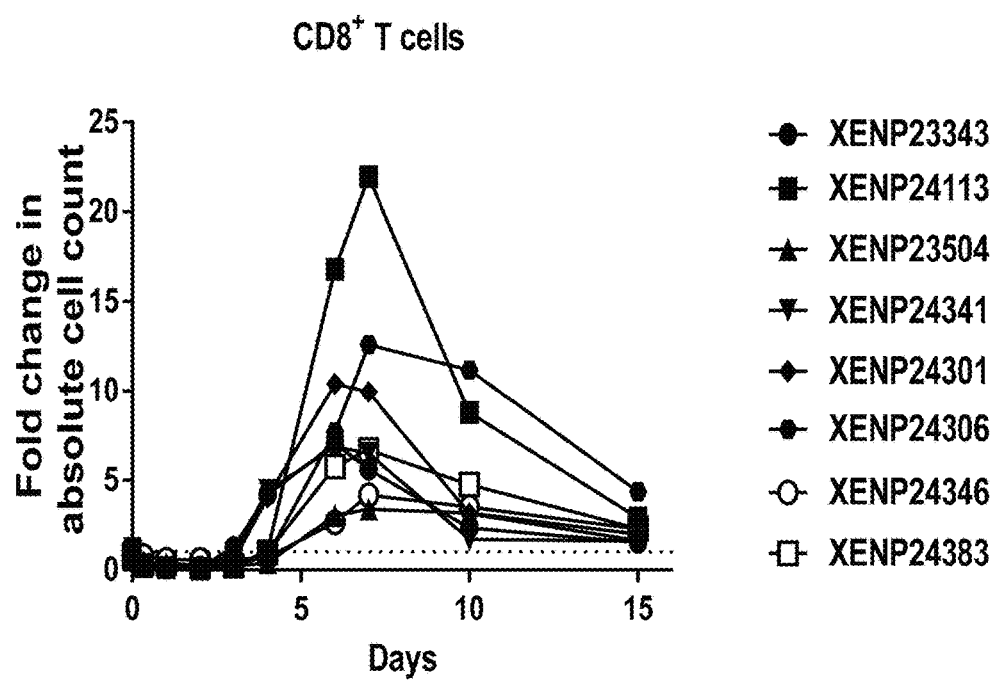
Figure 103B:
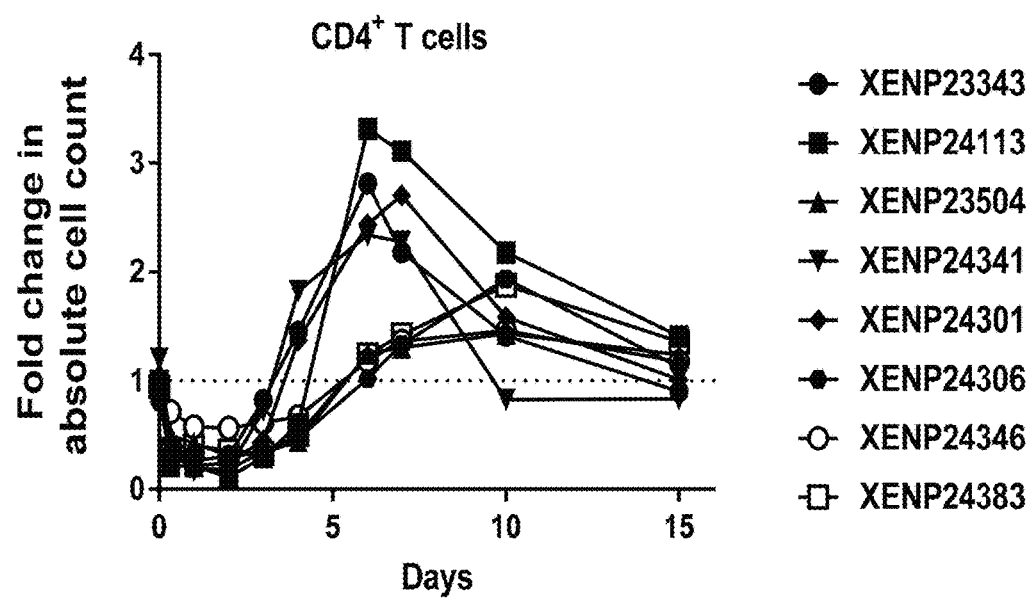
Figure 103C:
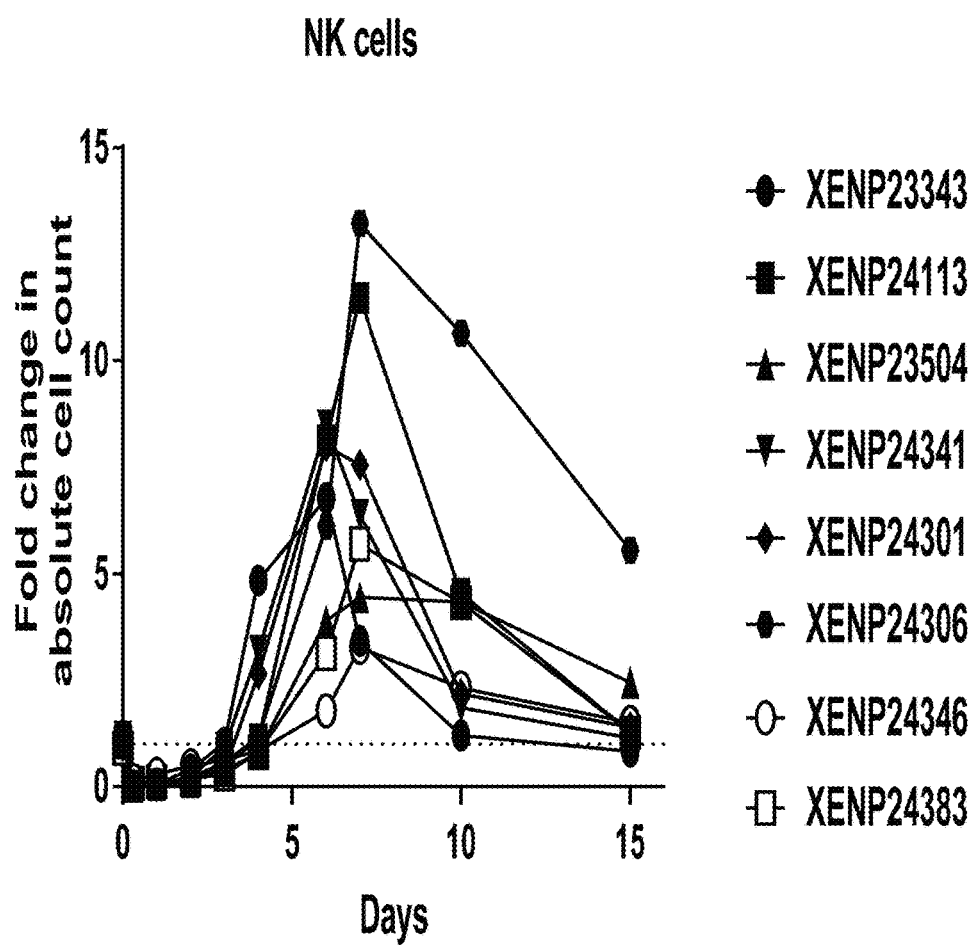

FIGS. 103A-103C depict (A) CD8+ T cell, (B) CD4+ T cell, and (C) NK cell counts in cynomolgus monkeys after treatment with IL-15/Rα variants on Day 1.

FIGS. 104A-104Z, 104AA-104AZ, and 104BA-104BL depicts sequences of the invention. The CDRs are in bold, IL-15 and IL15-Rα(sushi) are underlined, linkers are double underlined, and slashes (/) are between IL-15, IL15-Rα (sushi), linkers, and Fc domains.

FIG. 105 depicts some preferred embodiments of the invention. "Xtend" versions contain the 428L/434S variants in the Fc domains of each monomer.

FIG. 106 depicts a list of engineered heterodimer-skewing (e.g. "steric heterodimerization") Fc variants with heterodimer yields (determined by HPLC-CIEX) and thermal stabilities (determined by DSC). Not determined thermal stability is denoted by "n. d.".

DETAILED DESCRIPTION OF THE INVENTION

I. Definitions

In order that the application may be more completely understood, several definitions are set forth below. Such definitions are meant to encompass grammatical equivalents.

By "ablation" herein is meant a decrease or removal of activity. Thus for example, "ablating FcγR binding" means the Fc region amino acid variant has less than 50% starting binding as compared to an Fc region not containing the specific variant, with less than 70-80-90-95-98% loss of activity being preferred, and in general, with the activity being below the level of detectable binding in a Biacore assay. Of particular use in the ablation of FcγR binding are those shown in FIG. 86. However, unless otherwise noted, the Fc monomers of the invention retain binding to the FcRn receptor.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity. As is discussed herein, many embodiments of the invention ablate ADCC activity entirely.

By "ADCP" or antibody dependent cell-mediated phagocytosis as used herein is meant the cell-mediated reaction wherein nonspecific cytotoxic cells that express FcγRs recognize bound antibody on a target cell and subsequently cause phagocytosis of the target cell.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g., the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAsp-Glu after position 233 and before position 234.

By "amino acid deletion" or "deletion" as used herein is meant the removal of an amino acid sequence at a particular position in a parent polypeptide sequence. For example, E233- or E233#, E233( ) or E233del designates a deletion of glutamic acid at position 233. Additionally, EDA233- or EDA233# designates a deletion of the sequence GluAspAla that begins at position 233.

By "variant protein" or "protein variant", or "variant" as used herein is meant a protein that differs from that of a parent protein by virtue of at least one amino acid modification. Protein variant may refer to the protein itself, a composition comprising the protein, or the amino sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide, for example an Fc parent polypeptide, is a human wild type sequence, such as the Fc region from IgG1, IgG2, IgG3 or IgG4, although human sequences with variants can also serve as "parent polypeptides", for example the IgG1/2 hybrid can be included. The protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it.

Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain. The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as M428L/N434S, and so on. For all positions discussed in the present invention that relate to antibodies, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference). The modification can be an addition, deletion, or substitution. Substitutions can include naturally occurring amino acids and, in some cases, synthetic amino acids. Examples include U.S. Pat. No. 6,586,207; WO 98/48032; WO 03/073238; US2004-0214988A1; WO 05/35727A2; WO 05/74524A2; J. W. Chin et al., (2002), Journal of the American Chemical Society 124:9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

As used herein, "protein" herein is meant at least two covalently attached amino acids, which includes proteins, polypeptides, oligopeptides and peptides. The peptidyl group may comprise naturally occurring amino acids and peptide bonds, or synthetic peptidomimetic structures, i.e. "analogs", such as peptoids (see Simon et al., PNAS USA 89(20):9367 (1992), entirely incorporated by reference). The amino acids may either be naturally occurring or synthetic (e.g. not an amino acid that is coded for by DNA); as will be appreciated by those in the art. For example, homophenylalanine, citrulline, ornithine and norleucine are considered synthetic amino acids for the purposes of the invention, and both D- and L-(R or S) configured amino acids may be utilized. The variants of the present invention may comprise modifications that include the use of synthetic amino acids incorporated using, for example, the technologies developed by Schultz and colleagues, including but not limited to methods described by Cropp & Shultz, 2004, Trends Genet. 20(12):625-30, Anderson et al., 2004, Proc Natl Acad Sci USA 101 (2):7566-71, Zhang et al., 2003, 303(5656):371-3, and Chin et al., 2003, Science 301(5635): 964-7, all entirely incorporated by reference. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants can be used to increase binding to the FcRn receptor, and in some cases, to increase serum half-life. In general, unless otherwise noted, the Fc monomers of the invention retain binding to the FcRn receptor (and, as noted below, can include amino acid variants to increase binding to the FcRn receptor).

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below.

By "Fc" or "Fc region" or "Fc domain" as used herein is meant the polypeptide comprising the constant region of an antibody excluding, in some instances, the first constant region immunoglobulin domain (e.g., CH1) or a portion thereof, and in some cases, part of the hinge. Thus, an Fc can refer to the last two constant region immunoglobulin domains (e.g., CH2 and CH3) of IgA, IgD, and IgG, the last three constant region immunoglobulin domains of IgE and IgM, and the flexible hinge N-terminal to these domains. For IgA and IgM, Fc may include the J chain. For IgG, the Fc domain comprises immunoglobulin domains Cγ2 and Cγ3 (Cγ2 and Cγ3) and the lower hinge region between Cγ1 (Cγ1) and Cγ2 (Cγ2). In some embodiments, an Fc refers to a truncated CH1 domain, and CH2 and CH3 of an immunoglobulin. Although the boundaries of the Fc region may vary, the human IgG heavy chain Fc region is usually defined to include residues E216 or C226 or P230 to its carboxyl-terminus, wherein the numbering is according to the EU index as in Kabat. In some embodiments, as is more fully described below, amino acid modifications are made to the Fc region, for example to alter binding to one or more FcγR receptors or to the FcRn receptor.

By "Fc fusion protein" or "immunoadhesin" herein is meant a protein comprising an Fc region, generally linked (optionally through a linker moiety, as described herein) to a different protein, such as to IL-15 and/or IL-15R, as described herein. In some instances, two Fc fusion proteins can form a homodimeric Fc fusion protein or a heterodimeric Fc fusion protein with the latter being preferred. In some cases, one monomer of the heterodimeric Fc fusion protein comprises an Fc domain alone (e.g., an empty Fc domain) and the other monomer is an Fc fusion, comprising a variant Fc domain and a protein domain, such as a receptor, ligand or other binding partner.

By "position" as used herein is meant a location in the sequence of a protein. Positions may be numbered sequentially, or according to an established format, for example the EU index for antibody numbering.

By "strandedness" in the context of the monomers of the heterodimeric antibodies of the invention herein is meant that, similar to the two strands of DNA that "match", heterodimerization variants are incorporated into each monomer so as to preserve the ability to "match" to form heterodimers. For example, if some pI variants are engineered into monomer A (e.g. making the pI higher) then steric variants that are "charge pairs" that can be utilized as well do not interfere with the pI variants, e.g. the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer that incorporates one set of the pair will go, such that pI separation is maximized using the pI of the skews as well.

By "wild type or WT" herein is meant an amino acid sequence or a nucleotide sequence that is found in nature, including allelic variations. A WT protein has an amino acid sequence or a nucleotide sequence that has not been intentionally modified.

The heterodimeric proteins of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated protein," refers to aa protein which is substantially free of other antibodies having different antigenic specificities. "Recombinant" means the proteins are generated using recombinant nucleic acid techniques in exogeneous host cells.

"Percent (%) amino acid sequence identity" with respect to a protein sequence is defined as the percentage of amino acid residues in a candidate sequence that are identical with the amino acid residues in the specific (parental) sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. One particular program is the ALIGN-2 program outlined at paragraphs [0279] to [0280] of US Pub. No. 20160244525, hereby incorporated by reference.

The degree of identity between an amino acid sequence of the present invention ("invention sequence") and the parental amino acid sequence is calculated as the number of exact matches in an alignment of the two sequences, divided by the length of the "invention sequence," or the length of the parental sequence, whichever is the shortest. The result is expressed in percent identity.

In some embodiments, two or more amino acid sequences are at least 50%, 60%, 70%, 80%, or 90% identical. In some embodiments, two or more amino acid sequences are at least 95%, 97%, 98%, 99%, or even 100% identical.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Before the invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

II. Heterodimeric Fc Fusion Proteins

The present invention relates to heterodimeric Fc fusion proteins that include IL-15 and IL-15 receptor alpha (IL-15Rα) protein domains in different orientations. The Fc domains can be derived from IgG Fc domains, e.g., IgG1, IgG2, IgG3 or IgG4 Fc domains, with IgG1 Fc domains finding particular use in the invention.

The carboxy-terminal portion of each chain defines a constant region primarily responsible for effector function. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference). Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 220, and the IgG CH2 domain begins at residue EU position 237. Thus for IgG the antibody hinge is herein defined to include positions 221 (D221 in IgG1) to 236 (G236 in IgG1), wherein the numbering is according to the EU index as in Kabat. In some embodiments, for example in the context of an Fc region, the lower hinge is included, with the "lower hinge" generally referring to positions 226 or 230. As noted herein, pI variants can be made in the hinge region as well.

Thus, the present invention provides different antibody domains. As described herein and known in the art, the heterodimeric proteins of the invention comprise different domains, which can be overlapping as well. These domains include, but are not limited to, the Fc domain, the CH1 domain, the CH2 domain, the CH3 domain, the hinge domain, and the heavy constant domain (CH1-hinge-Fc domain or CH1-hinge-CH2-CH3).

Thus, the "Fc domain" includes the —CH2-CH3 domain, and optionally a hinge domain. In some embodiments, the Fc domain also includes a truncated CH1 domain. In the embodiments herein, when a protein fragment, e.g., IL-15 or IL-15Rα is attached to an Fc domain, it is the C-terminus of the IL-15 or IL-15Rα construct that is attached to all or part of the hinge of the Fc domain; for example, it is generally attached to the sequence EPKSS (SEQ ID NO: 1204) which is the beginning of the hinge. In other embodiments, when a protein fragment, e.g., IL-15 or IL-15Rα, is attached to an Fc domain, it is the C-terminus of the IL-15 or IL15Rα construct that is attached to the CH1 domain of the Fc domain.

In some of the constructs and sequences outlined herein of an Fc domain protein, the C-terminus of the IL-15 or IL-15Rα protein fragment is attached to the N-terminus of a domain linker, the C-terminus of which is attached to the N-terminus of a constant Fc domain (N-IL-15 or IL-15Rα protein fragment-linker-Fc domain-C) although that can be switched (N-Fc domain-linker-IL-15 or IL-15Rα protein fragment-C). In other constructs and sequence outlined herein, C-terminus of a first protein fragment is attached to the N-terminus of a second protein fragment, optionally via a domain linker, the C-terminus of the second protein fragment is attached to the N-terminus of a constant Fc domain, optionally via a domain linker. In yet other constructs and sequences outlined herein, a constant Fc domain that is not attached to a first protein fragment or a second protein fragment is provided. A heterodimer Fc fusion protein can contain two or more of the exemplary monomeric Fc domain proteins described herein.

In some embodiments, the linker is a "domain linker", used to link any two domains as outlined herein together, some of which are depicted in FIG. 87. While any suitable linker can be used, many embodiments utilize a glycine-serine polymer, including for example (GS)n (SEQ ID NO: 1199), (GSGGS)n (SEQ ID NO: 1200), (GGGGS)n (SEQ ID NO: 1203), and (GGGS)n (SEQ ID NO: 1201), where n is an integer of at least one (and generally from 0 to 1 to 2 to 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers.

In one embodiment, heterodimeric Fc fusion proteins contain at least two constant domains which can be engineered to produce heterodimers, such as pI engineering. Other Fc domains that can be used include fragments that contain one or more of the CH1, CH2, CH3, and hinge domains of the invention that have been pI engineered. In particular, the formats depicted in FIGS. 9A-9G, and 39A-39D are heterodimeric Fc fusion proteins, meaning that the protein has two associated Fc sequences self-assembled into a heterodimeric Fc domain and at least one protein fragment (e.g., 1, 2 or more protein fragments). In some cases, a first protein fragment is linked to a first Fc sequence and a second protein fragment is linked to a second Fc sequence. In other cases, a first protein fragment is linked to a first Fc sequence, and the first protein fragment is non-covalently attached to a second protein fragment that is not linked to an Fc sequence. In some cases, the heterodimeric Fc fusion protein contains a first protein fragment linked to a second protein fragment which is linked a first Fc sequence, and a second Fc sequence that is not linked to either the first or second protein fragments.

Accordingly, in some embodiments the present invention provides heterodimeric Fc fusion proteins that rely on the use of two different heavy chain variant Fc sequences, that will self-assemble to form a heterodimeric Fc domain fusion polypeptide.

The present invention is directed to novel constructs to provide heterodimeric Fc fusion proteins that allow binding to one or more binding partners, ligands or receptors. The heterodimeric Fc fusion constructs are based on the self-assembling nature of the two Fc domains of the heavy chains of antibodies, e.g., two "monomers" that assemble into a "dimer". Heterodimeric Fc fusions are made by altering the amino acid sequence of each monomer as more fully discussed below. Thus, the present invention is generally directed to the creation of heterodimeric Fc fusion proteins which can co-engage binding partner(s) or ligand(s) or receptor(s) in several ways, relying on amino acid variants in the constant regions that are different on each chain to promote heterodimeric formation and/or allow for ease of purification of heterodimers over the homodimers.

There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers. As is generally described in WO2014/145806, hereby incorporated by reference in its entirety and specifically as below for the discussion of "heterodimerization variants", useful mechanisms for heterodimerization include "knobs and holes" ("KIH"; sometimes herein as "skew" variants (see discussion in WO2014/145806), "electrostatic steering" or "charge pairs" as described in WO2014/145806, pI variants as described in WO2014/145806, and general additional Fc variants as outlined in WO2014/145806 and below.

In the present invention, there are several basic mechanisms that can lead to ease of purifying heterodimeric antibodies; one relies on the use of pI variants, such that each monomer has a different pI, thus allowing the isoelectric purification of A-A, A-B and B-B dimeric proteins. Alternatively, some formats also allow separation on the basis of size. As is further outlined below, it is also possible to "skew" the formation of heterodimers over homodimers. Thus, a combination of steric heterodimerization variants and pI or charge pair variants find particular use in the invention.

In general, embodiments of particular use in the present invention rely on sets of variants that include skew variants, that encourage heterodimerization formation over homodimerization formation, coupled with pI variants, which increase the pI difference between the two monomers.

Additionally, as more fully outlined below, depending on the format of the heterodimer Fc fusion protein, pI variants can be either contained within the constant and/or Fc domains of a monomer, or domain linkers can be used. That is, the invention provides pI variants that are on one or both of the monomers, and/or charged domain linkers as well. In addition, additional amino acid engineering for alternative functionalities may also confer pI changes, such as Fc, FcRn and KO variants.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. As discussed, the pI changes of either or both monomers can be done by removing or adding a charged residue (e.g., a neutral amino acid is replaced by a positively or negatively charged amino acid residue, e.g., glycine to glutamic acid), changing a charged residue from positive or negative to the opposite charge (e.g. aspartic acid to lysine) or changing a charged residue to a neutral residue (e.g., loss of a charge; lysine to serine.). A number of these variants are shown in the Figures.

Accordingly, this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI (wt A−+B or wt A−−B), or by increasing one region and decreasing the other region (A+−B− or A−B+).

Thus, in general, a component of some embodiments of the present invention are amino acid variants in the constant regions that are directed to altering the isoelectric point (pI) of at least one, if not both, of the monomers of a dimeric protein by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components. As is known in the art, different Fcs will have different starting pIs which are exploited in the present invention. In general, as outlined herein, the pIs are engineered to result in a total pI difference of each monomer of at least about 0.1 logs, with 0.2 to 0.5 being preferred as outlined herein.

As will be appreciated by those in the art, the number of pI variants to be included on each or both monomer(s) to get good separation will depend in part on the starting pI of the components. That is, to determine which monomer to engineer or in which "direction" (e.g., more positive or more negative), the sequences of the Fc domains, and in some cases, the protein domain(s) linked to the Fc domain are calculated and a decision is made from there. As is known in the art, different Fc domains and/or protein domains will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, in some embodiments, heterodimers can be separated from homodimers on the basis of size. As shown in the Figures, for example, several of the formats allow separation of heterodimers and homodimers on the basis of size.

In the case where pI variants are used to achieve heterodimerization, by using the constant region(s) of Fc domains(s), a more modular approach to designing and purifying heterodimeric Fc fusion proteins is provided. Thus, in some embodiments, heterodimerization variants (including skew and purification heterodimerization variants) must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition, it should be noted that the pI variants of the heterodimerization variants give an additional benefit for the analytics and quality control process of Fc fusion proteins, as the ability to either eliminate, minimize and distinguish when homodimers are present is significant. Similarly, the ability to reliably test the reproducibility of the heterodimeric Fc fusion protein production is important.

A. Heterodimerization Variants

The present invention provides heterodimeric proteins, including heterodimeric Fc fusion proteins in a variety of formats, which utilize heterodimeric variants to allow for heterodimeric formation and/or purification away from homodimers. The heterodimeric fusion constructs are based on the self-assembling nature of the two Fc domains, e.g., two "monomers" that assemble into a "dimer".

There are a number of suitable pairs of sets of heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other; that is, these pairs of sets form an interface between the two monomers that encourages heterodimer formation and discourages homodimer formation, allowing the percentage of heterodimers that spontaneously form under biological conditions to be over 90%, rather than the expected 50% (25% homodimer A/A: 50% heterodimer A/B:25% homodimer B/B).

B. Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in in the FIG. 29 of U.S. Ser. No. 15/141,350, all of which is hereby incorporated by reference in its entirety, as well as in FIG. 84.

One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem.

285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g., these are "monomer corresponding sets) and C220E/P228E/368E paired with C220R/E224R/P228R/K409R.

Additional monomer A and monomer B variants that can be combined with other variants, optionally and independently in any amount, such as pI variants outlined herein or other steric variants that are shown in FIG. 37 of US 2012/0149876, all of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

A list of suitable skew variants is found in FIG. 84. Of particular use in many embodiments are the pairs of sets including, but not limited to, S364K/E357Q: L368D/K370S; L368D/K370S: S364K; L368E/K370S: S364K; T411T/E360E/Q362E: D401K; L368D/K370S: S364K/E357L, K370S: S364K/E357Q and T366S/L368A/Y407V: T366W (optionally including a bridging disulfide, T366S/L368A/Y407V/Y349C: T366W/S354C). In terms of nomenclature, the pair "S364K/E357Q: L368D/K370S" means that one of the monomers has the double variant set S364K/E357Q and the other has the double variant set L368D/K370S; as above, the "strandedness" of these pairs depends on the starting pI.

C. pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Preferred combinations of pI variants are shown in FIG. 30 of U.S. Ser. No. 15/141,350, all of which are herein incorporated by reference in its entirety. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, a preferred combination of pI variants has one monomer comprising 208D/295E/384D/418E/421D variants (N208D/Q295E/N384D/Q418E/N421D when relative to human IgG1) if one of the Fc monomers includes a CH1 domain. In some instances, the second monomer comprising a positively charged domain linker, including (GKPGS)$_4$ (SEQ ID NO: 1202). In some cases, the first monomer includes a CH1 domain, including position 208. Accordingly, in constructs that do not include a CH1 domain (for example for heterodimeric Fc fusion proteins that do not utilize a CH1 domain on one of the domains), a preferred negative pI variant Fc set includes 295E/384D/418E/421D variants (Q295E/N384D/Q418E/N421D when relative to human IgG1).

In some embodiments, mutations are made in the hinge domain of the Fc domain, including positions 221, 222, 223, 224, 225, 233, 234, 235 and 236. It should be noted that changes in 233-236 can be made to increase effector function (along with 327A) in the IgG2 backbone. Thus, pI mutations and particularly substitutions can be made in one or more of positions 221-225, with 1, 2, 3, 4 or 5 mutations finding use in the present invention. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. In some cases, only pI substitutions are done in the hinge domain, and in others, these substitution(s) are added to other pI variants in other domains in any combination.

In some embodiments, mutations can be made in the CH2 region, including positions 274, 296, 300, 309, 320, 322, 326, 327, 334 and 339. Again, all possible combinations of these 10 positions can be made; e.g., a pI antibody may have 1, 2, 3, 4, 5, 6, 7, 8, 9 or 10 CH2 pI substitutions.

Specific substitutions that find use in lowering the pI of CH2 domains include, but are not limited to, a non-native glutamine or glutamic acid at position 274, a non-native phenylalanine at position 296, a non native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non native threonine at position 339, and all possible combinations within CH2 and with other domains.

In this embodiment, the mutations can be independently and optionally selected from position 355, 359, 362, 384, 389, 392, 397, 418, 419, 444 and 447. Specific substitutions that find use in lowering the pI of CH3 domains include, but are not limited to, a non native glutamine or glutamic acid at position 355, a non-native serine at position 384, a non-native asparagine or glutamic acid at position 392, a non-native methionine at position 397, a non native glutamic acid at position 419, a non native glutamic acid at position 359, a non native glutamic acid at position 362, a non native glutamic acid at position 389, a non native glutamic acid at position 418, a non native glutamic acid at position 444, and a deletion or non-native aspartic acid at position 447.

D. Isotypic Variants

In addition, many embodiments of the invention rely on the "importation" of pI amino acids at particular positions from one IgG isotype into another, thus reducing or eliminating the possibility of unwanted immunogenicity being introduced into the variants. A number of these are shown in FIG. 21 of US Publ. App. No. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant Fc fusion protein. However, it should be noted as discussed below that even changes in IgG2 molecules allow for increased serum half-life.

In other embodiments, non-isotypic amino acid changes are made, either to reduce the overall charge state of the resulting protein (e.g., by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

E. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Publ. App. No. 2014/0370013. As discussed herein, which monomer to engineer is generally decided by the inherent pI of each monomer.

F. pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall'Acqua et al. showed that Fc mutants with increased FcRn binding at pH 6 and pH 7.4 actually had reduced serum concentrations and the same half-life as wild-type Fc (Dall' Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

G. Additional Fc Variants for Additional Functionality

In addition to pI amino acid variants, there are a number of useful Fc amino acid modification that can be made for a variety of reasons, including, but not limited to, altering binding to one or more FcγR receptors, altered binding to FcRn receptors, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

H. FcγR Variants

Accordingly, there are a number of useful Fc substitutions that can be made to alter binding to one or more of the FcγR receptors. Substitutions that result in increased binding as well as decreased binding can be useful. For example, it is known that increased binding to FcγRIIIa results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, amino acid substitutions that increase affinity for FcγRIIc can also be included in the Fc domain variants outlined herein. The substitutions described in, for example, U.S. Ser. Nos. 11/124,620 and 14/578,305 are useful.

In addition, there are additional Fc substitutions that find use in increased binding to the FcRn receptor and increased serum half-life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L.

I. Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g., FcγR1, FcγRIIa, FcγRIIb, FcγRIIIa, etc.) to avoid additional mechanisms of action. That is, for example, in many embodiments, particularly in the use of bispecific immunomodulatory antibodies desirable to ablate FcγRIIIa binding to eliminate or significantly reduce ADCC activity such that one of the Fc domains comprises one or more Fcγ receptor ablation variants. These ablation variants are depicted in FIG. 31 of U.S. Ser. No. 15/141,350, all of which are herein incorporated by reference in its entirety, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to the EU index. It should be noted that the ablation variants referenced herein ablate FcγR binding but generally not FcRn binding.

J. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein.

In addition, a monomeric Fc domain can comprise a set of amino acid substitutions that includes C220S/S267K/L368D/K370S or C220S/S267K/S364K/E357Q.

In addition, the heterodimeric Fc fusion proteins can comprise skew variants (e.g., a set of amino acid substitutions as shown in FIGS. 1A-1C of U.S. Ser. No. 15/141,350, all of which are herein incorporated by reference in its entirety), with particularly useful skew variants being selected from the group consisting of S364K/E357Q: L368D/K370S; L368D/K370S:S364K; L368E/K370S: S364K; T411T/E360E/Q362E:D401K; L368D/K370S: S364K/E357L, K370S: S364K/E357Q, T366S/L368A/Y407V: T366W and T366S/L368A/Y407V/Y349C: T366W/S354C, optionally ablation variants, optionally charged domain linkers and the heavy chain comprises pI variants.

In some embodiments, the Fc domain comprising an amino acid substitution selected from the group consisting of: 236R, 239D, 239E, 243L, M252Y, V259I, 267D, 267E, 298A, V308F, 328F, 328R, 330L, 332D, 332E, M428L, N434A, N434S, 236R/328R, 239D/332E, M428L, 236R/328F, V259I/V308F, 267E/328F, M428L/N434S, Y436I/M428L, Y436V/M428L, Y436I/N434S, Y436V/N434S, 239D/332E/330L, M252Y/S254T/T256E, V259I/V308F/M428L, E233P/L234V/L235A/G236del/S267K, G236R/L328R and PVA/S267K. In some cases, the Fc domain comprises the amino acid substitution 239D/332E. In other cases, the Fc domain comprises the amino acid substitution G236R/L328R or PVA/S267K.

In one embodiment, a particular combination of skew and pI variants that finds use in the present invention is T366S/L368A/Y407V:T366W (optionally including a bridging disulfide, T366S/L368A/Y407V/Y349C: T366W/S354C) with one monomer comprises Q295E/N384D/Q418E/N481D and the other a positively charged domain linker. As will be appreciated in the art, the "knobs in holes" variants do not change pI, and thus can be used on either monomer.

III. IL-15 and IL15Rα Protein Domains

The present invention provides heterodimeric Fc fusion proteins containing IL-15 and IL-15Rα proteins. As shown in the figures, the IL-15 complex can take several forms. As stated above, the IL-15 protein on its own is less stable than when complexed with the IL-15Rα protein. As is known in the art, the IL-15Rα protein contains a "sushi domain", which is the shortest region of the receptor that retains IL-15 binding activity. Thus, while heterodimeric fusion proteins comprising the entire IL-15Rα protein can be made, preferred embodiments herein include complexes that just use the sushi domain, the sequence of which is shown in the figures.

Figure 9A:
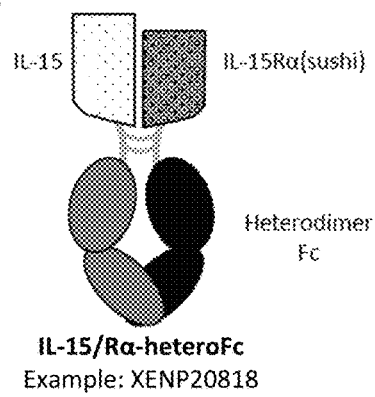
Figure 9B:
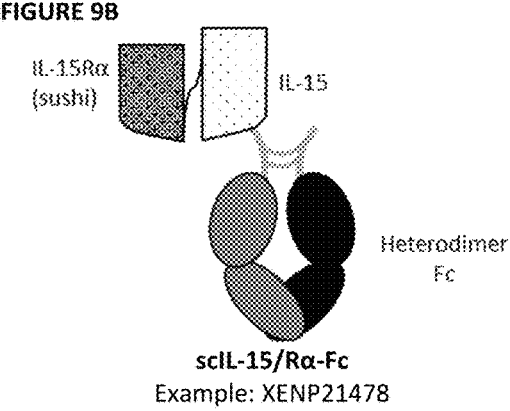

Accordingly, the IL-15 complexes generally comprises the IL-15 protein and the sushi domain of IL IL-15Rα (unless otherwise noted that the full length sequence is used, "IL-15Rα", "IL-15Rα(sushi)" and "sushi" are used interchangeably throughout). This complex can be used in three different formats. As shown in FIG. 9A, the IL-15 protein and the IL-15Rα(sushi) are not covalently attached, but rather are self-assembled through regular ligand-ligand interactions. As is more fully described herein, it can be either the IL-15 domain or the sushi domain that is covalently linked to the Fc domain (generally using an optional domain linker). Alternatively, they can be covalently attached using a domain linker as generally shown in FIGS. 9B, 9E, 9G FIG. 9B depicts the sushi domain as the N-terminal domain, although this can be reversed. Finally, each of the IL-15 and sushi domains can be engineered to contain a cysteine amino acid, that forms a disulfide bond to form the complex as is generally shown in FIGS. 39A-39D, again, with either the IL-15 domain or the sushi domain being covalently attached (using an optional domain linker) to the Fc domain.

In some embodiments, the human IL-15 protein has the amino acid sequence set forth in NCBI Ref. Seq. No. NP_000576.1 or SEQ ID NO:1. In some cases, the coding sequence of human IL-15 is set forth in NCBI Ref. Seq. No. NM_000585. An exemplary IL-15 protein of the Fc fusion heterodimeric protein outlined herein can have the amino acid sequence of SEQ ID NO:2 or amino acids 49-162 of SEQ ID NO:1. In some embodiments, the IL-15 protein has at least 90%, e.g., 90%, 91%, 92%, 93%, 94%, 95%, 96%, 97%, 98%, 99%, or more sequence identity to SEQ ID NO:2. In some embodiments, the IL-15 protein has the amino acid sequence set forth in SEQ ID NO:2 and the amino acid substitution N72D. In other embodiments, the IL-15 protein has the amino acid sequence of SEQ ID NO:2 and one or more amino acid substitutions selected from the group consisting of C42S, L45C, Q48C, V49C, L52C, E53C, E87C, and E89C. Optionally, the IL-15 protein also has an N72D substitution. The IL-15 protein of the Fc fusion protein can have 1, 2, 3, 4, 5, 6, 7, 8 or 9 amino acid substitutions.

The amino acid substitution(s) may be isosteric substitutions at the IL-15:IL-2β and IL-15:common gamma chain interface. In some embodiments, the human IL-15 protein has one or more amino acid substitutions selected from the group consisting of N1D, N4D, D8N, D30N, D61N, E64Q, N65D, Q108E, and any combination thereof. In some embodiments, the IL-15 protein has the amino acid substitution Q108E. In some cases, the IL-15 protein has 1, 2, 3, 4, 5, 6, 7, 8, or more amino acid substitutions. The IL-15 protein can have a N1D, N4D, D8N, D30N, D61N, E64Q, N65D, or Q108E substitution. In some embodiments, the amino acid substitution can include N1D/D61N, N1D/E64Q, N4D/D61N, N4D/E64Q, D8N/D61N, D8N/E64Q, D61N/E64Q, E64Q/Q108E, N1D/N4D/D8N, D61N/E64Q/N65D, N1D/D61N/E64Q, N1D/D61N/E64Q/Q108E, or N4D/D61N/E64Q/Q108E. In some embodiments, the IL-15 protein has the amino acid substitutions D30N/E64Q/N65D.

In some embodiments, the human IL-15 receptor alpha (IL-15Rα) protein has the amino acid sequence set forth in NCBI Ref. Seq. No. NP_002180.1 or SEQ ID NO:3. In some cases, the coding sequence of human IL-15Rα is set forth in NCBI Ref. Seq. No. NM_002189.3. An exemplary the IL-15Rα protein of the Fc fusion heterodimeric protein outlined herein can comprise or consist of the sushi domain of SEQ ID NO:3 (e.g., amino acids 31-95 of SEQ ID NO:3), or in other words, the amino acid sequence of SEQ ID NO:4. In some embodiments, the IL-15Rα protein has the amino acid sequence of SEQ ID NO:4 and an amino acid insertion selected from the group consisting of D96, P97, A98, D96/P97, D96/C97, D96/P97/A98, D96/P97/C98, and D96/C97/A98, wherein the amino acid position is relative to full-length human IL-15Rα protein or SEQ ID NO:3. For instance, amino acid(s) such as D (e.g., Asp), P (e.g., Pro), A (e.g., Ala), DP (e.g., Asp-Pro), DC (e.g., Asp-Cys), DPA (e.g., Asp-Pro-Ala), DPC (e.g., Asp-Pro-Cys), or DCA (e.g., Asp-Cys-Ala) can be added to the C-terminus of the IL-15Rα protein of SEQ ID NO:4. In some embodiments, the IL-15Rα protein has the amino acid sequence of SEQ ID NO:4 and one or more amino acid substitutions selected from the group consisting of K34C, A37C, G38C, S40C, and L42C, wherein the amino acid position is relative to SEQ ID NO:4. The IL-15Rα protein can have 1, 2, 3, 4, 5, 6, 7, 8 or more amino acid mutations (e.g., substitutions, insertions and/or deletions).

IV. Domain Linkers

In some embodiments, the IL-15 protein and IL-15Rα protein are attached together via a linker. Optionally, the proteins are not attached via a linker. In other embodiments, the IL-15 protein and IL-15Rα protein are noncovalently attached. In some embodiments, the IL-15 protein is attached to an Fc domain via a linker. In certain embodiments, the IL-15 protein is attached to an Fc domain directly, such as without a linker. In other embodiments, the IL-15Rα protein is attached to an Fc domain via a linker. In other embodiments, the IL-15Rα protein is attached to an Fc domain directly. In some cases, a linker is not used to attach the IL-15 protein or IL-15Rα protein to an Fc domain.

In some embodiments, the linker is a "domain linker", used to link any two domains as outlined herein together. While any suitable linker can be used, many embodiments utilize a glycine-serine polymer, including for example (GS)n (SEQ ID NO: 1199), (GSGGS)n (SEQ ID NO: 1200), (GGGGS)n (SEQ ID NO: 1203), and (GGGS)n (SEQ ID NO: 1201), where n is an integer of at least 0 (and generally from 0 to 1 to 2 to 3 to 4 to 5) as well as any peptide sequence that allows for recombinant attachment of the two domains with sufficient length and flexibility to allow each domain to retain its biological function. In certain cases, useful linkers include $(GGGGS)_0$ or $(GGGGS)_1$ (SEQ ID NO: 14) or $(GGGGS)_2$ (SEQ ID NO: 15). In some cases, and with attention being paid to "strandedness", as outlined below, charged domain linkers can be used as discussed herein and shown in FIG. 7.

V. Useful Formats of the Invention

As shown in FIGS. 9A-9G and 39A-39D there are a number of useful formats of the bispecific heterodimeric fusion proteins of the invention. In general, the heterodimeric fusion proteins of the invention have two functional components: an IL-15/IL-15Rα(sushi) component and an Fc component, both of which can take different forms as outlined herein and both of which can be combined with the other component in any configuration.

The first and the second Fc domains can have a set of amino acid substitutions selected from the group consisting of a) S267K/L368D/K370S:S267K/LS364K/E357Q; b) S364K/E357Q:L368D/K370S; c) L368D/K370S:S364K; d) L368E/K370S:S364K; e) T411T/E360E/Q362E:D401K; f) L368D/K370S:S364K/E357L and g) K370S:S364K/E357Q, according to EU numbering.

In some embodiments, the first and/or the second Fc domains have an additional set of amino acid substitutions comprising Q295E/N384D/Q418E/N421D, according to EU numbering.

Optionally, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

Optionally, the first and/or second Fc domains have 428L/434S variants for half life extension.

A. IL-15/Rα-heteroFc Format

In this embodiment, as shown in FIG. 9A, the heterodimeric fusion protein comprises two monomers. The first monomer comprises (from N- to C-terminus) IL-15-optional domain linker-CH2-CH3, where the domain linker sometimes comprises all or part of the hinge. The second monomer comprises the IL-15/Rα(sushi) domain-optional domain linker-CH2-CH3, where the domain linker sometimes comprises all or part of the hinge.

In the IL-15/Rα-heteroFc format, a preferred embodiment utilizes the skew variant pair S364K/E357Q: L368D/K370S.

In the IL-15/Rα-heteroFc format, a preferred embodiment utilizes the IL-15 variant Q108E.

In the IL-15/Rα-heteroFc format, a preferred embodiment utilizes the IL-15 variant Q108E and the skew variant pair S364K/E357Q: L368D/K370S.

In the IL-15/Rα-heteroFc format, a preferred embodiment utilizes the IL-15 variant Q108E and the skew variant pair S364K/E357Q: L368D/K370S and the 428L/434S variants on both monomers.

In the IL-15/Rα-heteroFc format, a preferred embodiment utilizes the IL-15 D30N/E64Q/N65D variants.

In the IL-15/Rα-heteroFc format, a preferred embodiment utilizes the IL-15 D30N/E64Q/N65D variants and the skew variant pair S364K/E357Q: L368D/K370S.

In the IL-15/Rα-heteroFc format, a preferred embodiment utilizes the IL-15 D30N/E64Q/N65D variants, the skew variant pair S364K/E357Q: L368D/K370S and the 428L/434S variants on each Fc monomer.

In the IL-15/Rα-heteroFc format, a preferred embodiment utilizes the IL-15 N65D variant.

In the IL-15/Rα-heteroFc format, a preferred embodiment utilizes the IL-15 N65D variant, and the skew variant pair S364K/E357Q: L368D/K370S In the IL-15/Rα-heteroFc format, a preferred embodiment utilizes the IL-15 N65D variant, the skew variant pair S364K/E357Q: L368D/K370S and the 428L/434S variants on each Fc monomer.

In the IL-15/Rα-heteroFc format, a preferred embodiment utilizes the IL-15 N4D/N65D variant.

In the IL-15/Rα-heteroFc format, a preferred embodiment utilizes the IL-15 N4D/N65D variant and the skew variant pair S364K/E357Q: L368D/K370S.

In the IL-15/Rα-heteroFc format, a preferred embodiment utilizes the IL-15 N4D/N65D variant, the skew variant pair S364K/E357Q: L368D/K370S and the 428L/434S variants on each Fc monomer.

In the IL-15/Rα-heteroFc format, a preferred embodiment utilizes the IL-15 N1D/N65D variant.

In the IL-15/Rα-heteroFc format, a preferred embodiment utilizes the IL-15 N1D/N65D variant and the skew variant pair S364K/E357Q: L368D/K370S.

In the IL-15/Rα-heteroFc format, a preferred embodiment utilizes the IL-15 N1D/N65D variant, the skew variant pair S364K/E357Q: L368D/K370S and the 428L/434S variants on each Fc monomer.

In the IL-15/Rα-heteroFc format, preferred embodiments are shown in FIG. 48A (XENP22822 including chain 1 (17693) and chain 2 (15908)), FIG. 94A (XENP23504 including chain 1 and chain 2), FIG. 104AO (XENP24045 including chain 1 and chain 2), FIG. 104AQ (XENP24306 including chain 1 and chain 2), FIG. 48A (XENP22821 including chain 1 and chain 2), FIG. 94A (XENP23343 including chain 1 and chain 2), FIG. 104AJ (XENP23557 including chain 1 and chain 2), FIG. 104AP (XENP24113 including chain 1 and chain 2), FIG. 104AP (XENP24051 including chain 1 and chain 2), FIG. 104AR (XENP24341 including chain 1 and chain 2), FIG. 104AP (XENP24052 including chain 1 and chain 2), and FIG. 104AP (XENP24301 including chain 1 and chain 2).

B. scIL-15-Rα-Fc

In this embodiment, as shown in FIG. 9B, the heterodimeric fusion protein comprises two monomers. The first monomer comprises (from N- to C-terminus) IL-15/Rα (sushi)-domain linker-IL-15-optional domain linker-CH2-CH3, where the domain linker sometimes comprises all or part of the hinge. The second monomer comprises and "empty" Fc, comprising all or part of the hinge-CH2-CH3. This is referred to as "scIL-15/Rα-Fc" with the "sc" standing for "single chain" (e.g. of the IL-15/sushi complex).

In the scIL-15/Rα-Fc format, a preferred embodiment utilizes the skew variant pair S364K/E357Q: L368D/K370S.

In the scIL-15/Rα-Fc format, a preferred embodiment utilizes the IL-15 variant Q108E.

In the scIL-15/Rα-Fc format, a preferred embodiment utilizes the IL-15 variant Q108E and the skew variant pair S364K/E357Q: L368D/K370S.

In the scIL-15/Rα-Fc format, a preferred embodiment utilizes the IL-15 variant Q108E and the skew variant pair S364K/E357Q: L368D/K370S and the 428L/434S variants on both monomers.

In the scIL-15/Rα-Fc format, a preferred embodiment utilizes the IL-15 D30N/E64Q/N65D variants.

In the scIL-15/Rα-Fc format, a preferred embodiment utilizes the IL-15 D30N/E64Q/N65D variants and the skew variant pair S364K/E357Q: L368D/K370S.

In the scIL-15/Rα-Fc format, a preferred embodiment utilizes the IL-15 D30N/E64Q/N65D variants, the skew variant pair S364K/E357Q: L368D/K370S and the 428L/434S variants on each Fc monomer.

In the scIL-15/Rα-Fc format, a preferred embodiment utilizes the IL-15 N65D variant.

In the scIL-15/Rα-Fc format, a preferred embodiment utilizes the IL-15 N65D variant, and the skew variant pair S364K/E357Q: L368D/K370S In the scIL-15/Rα-Fc format, a preferred embodiment utilizes the IL-15 N65D variant, the skew variant pair S364K/E357Q: L368D/K370S and the 428L/434S variants on each Fc monomer.

In the scIL-15/Rα-Fc format, a preferred embodiment utilizes the IL-15 N4D/N65D variant.

In the scIL-15/Rα-Fc format, a preferred embodiment utilizes the IL-15 N4D/N65D variant and the skew variant pair S364K/E357Q: L368D/K370S.

In the scIL-15/Rα-Fc format, a preferred embodiment utilizes the IL-15 N4D/N65D variant, the skew variant pair S364K/E357Q: L368D/K370S and the 428L/434S variants on each Fc monomer.

In the scIL-15/Rα-Fc format, a preferred embodiment utilizes the IL-15 N1D/N65D variant.

In the scIL-15/Rα-Fc format, a preferred embodiment utilizes the IL-15 N1D/N65D variant and the skew variant pair S364K/E357Q: L368D/K370S.

In the IL-15/Rα-heteroFc format, a preferred embodiment utilizes the IL-15 N1D/N65D variant, the skew variant pair S364K/E357Q: L368D/K370S and the 428L/434S variants on each Fc monomer.

C. ncIL-15/Rα-Fc

Figure 9C:
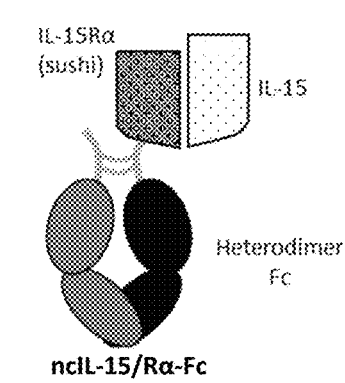

In this embodiment, as shown in FIG. 9C, the heterodimeric fusion protein comprises three monomers. The first monomer comprises (from N- to C-terminus) IL-15/Rα (sushi)-domain linker-CH2-CH3, where the domain linker sometimes comprises all or part of the hinge. The second monomer comprises and "empty" Fc, comprising all or part of the hinge-CH2-CH3. The third monomer is IL-15. This is referred to as "ncIL-15/Rα-Fc" with the "nc" standing for "non-covalent").

In the ncIL-15/Rα-Fc format, a preferred embodiment utilizes the skew variant pair S364K/E357Q: L368D/K370S.

In the ncIL-15/Rα-Fc format, a preferred embodiment utilizes the IL-15 variant Q108E.

In the ncIL-15/Rα-Fc format, a preferred embodiment utilizes the IL-15 variant Q108E and the skew variant pair S364K/E357Q: L368D/K370S.

In the ncIL-15/Rα-Fc format, a preferred embodiment utilizes the IL-15 variant Q108E and the skew variant pair S364K/E357Q: L368D/K370S and the 428L/434S variants on both monomers.

In the ncIL-15/Rα-Fc format, a preferred embodiment utilizes the IL-15 D30N/E64Q/N65D variants.

In the ncIL-15/Rα-Fc format, a preferred embodiment utilizes the IL-15 D30N/E64Q/N65D variants and the skew variant pair S364K/E357Q: L368D/K370S.

In the ncIL-15/Rα-Fc format, a preferred embodiment utilizes the IL-15 D30N/E64Q/N65D variants, the skew variant pair S364K/E357Q: L368D/K370S and the 428L/434S variants on each Fc monomer.

In the ncIL-15/Rα-Fc format, a preferred embodiment utilizes the IL-15 N65D variant.

In the ncIL-15/Rα-Fc format, a preferred embodiment utilizes the IL-15 N65D variant, and the skew variant pair S364K/E357Q: L368D/K370S In the ncIL-15/Rα-Fc format, a preferred embodiment utilizes the IL-15 N65D variant, the skew variant pair S364K/E357Q: L368D/K370S and the 428L/434S variants on each Fc monomer.

In the ncIL-15/Rα-Fc format, a preferred embodiment utilizes the IL-15 N4D/N65D variant.

In the ncIL-15/Rα-Fc format, a preferred embodiment utilizes the IL-15 N4D/N65D variant and the skew variant pair S364K/E357Q: L368D/K370S.

In the ncIL-15/Rα-Fc format, a preferred embodiment utilizes the IL-15 N4D/N65D variant, the skew variant pair S364K/E357Q: L368D/K370S and the 428L/434S variants on each Fc monomer.

In the ncIL-15/Rα-Fc format, a preferred embodiment utilizes the IL-15 N1D/N65D variant.

In the ncIL-15/Rα-Fc format, a preferred embodiment utilizes the IL-15 N1D/N65D variant and the skew variant pair S364K/E357Q: L368D/K370S.

In the ncIL-15/Rα-heteroFc format, a preferred embodiment utilizes the IL-15 N1D/N65D variant, the skew variant pair S364K/E357Q: L368D/K370S and the 428L/434S variants on each Fc monomer.

In the ncIL-15/Rα-heteroFc format, preferred embodiments are shown in FIG. 104AS (XENP24349 including chain 1 and chain 2) and FIG. 104AT (XENP24383 including chain 1 and chain 2).

D. Bivalent ncIL-15/Rα-Fc

Figure 9D:
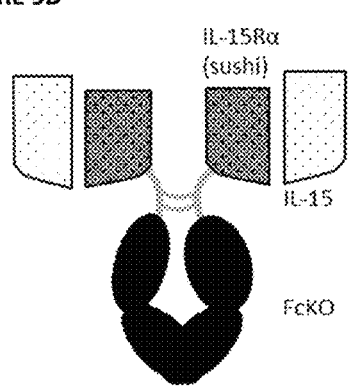
Figure 9E:
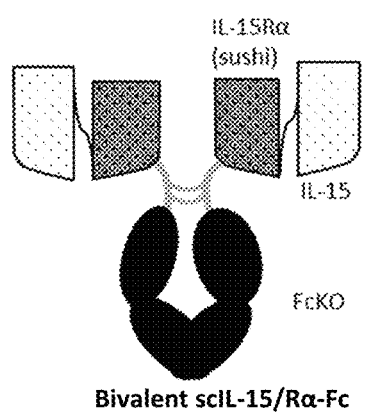
Figure 9F:
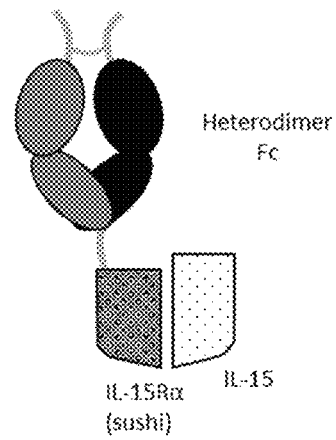
Figure 9G:
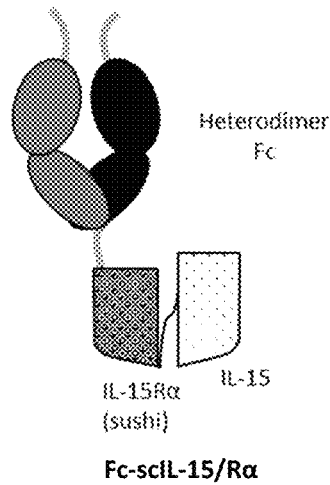

In this embodiment, as shown in FIG. 9D, the heterodimeric fusion protein comprises four monomers. The first and second monomers comprise (from N- to C-terminus) IL-15/Rα(sushi)-domain linker-CH2-CH3, where the domain linker sometimes comprises all or part of the hinge. The third and fourth monomers comprise IL-15. This is referred to as "bivalent ncIL-15/Rα-Fc" with the "nc" standing for "non-covalent").

In the bivalent ncIL-15/Rα-Fc format, a preferred embodiment utilizes the skew variant pair S364K/E357Q: L368D/K370S.

In the bivalent ncIL-15/Rα-Fc format, a preferred embodiment utilizes the IL-15 variant Q108E.

In the bivalent ncIL-15/Rα-Fc format, a preferred embodiment utilizes the IL-15 variant Q108E and the skew variant pair S364K/E357Q: L368D/K370S.

In the bivalent ncIL-15/Rα-Fc format, a preferred embodiment utilizes the IL-15 variant Q108E and the skew variant pair S364K/E357Q: L368D/K370S and the 428L/434S variants on both monomers.

In the bivalent ncIL-15/Rα-Fc format, a preferred embodiment utilizes the IL-15 D30N/E64Q/N65D variants.

In the bivalent ncIL-15/Rα-Fc format, a preferred embodiment utilizes the IL-15 D30N/E64Q/N65D variants and the skew variant pair S364K/E357Q: L368D/K370S.

In the bivalent ncIL-15/Rα-Fc format, a preferred embodiment utilizes the IL-15 D30N/E64Q/N65D variants, the skew variant pair S364K/E357Q: L368D/K370S and the 428L/434S variants on each Fc monomer.

In the bivalent ncIL-15/Rα-Fc format, a preferred embodiment utilizes the IL-15 N65D variant.

In the bivalent ncIL-15/Rα-Fc format, a preferred embodiment utilizes the IL-15 N65D variant, and the skew variant pair S364K/E357Q: L368D/K370S In the bivalent ncIL-15/Rα-Fc format, a preferred embodiment utilizes the IL-15 N65D variant, the skew variant pair S364K/E357Q: L368D/K370S and the 428L/434S variants on each Fc monomer.

In the bivalent ncIL-15/Rα-Fc format, a preferred embodiment utilizes the IL-15 N4D/N65D variant.

In the bivalent ncIL-15/Rα-Fc format, a preferred embodiment utilizes the IL-15 N4D/N65D variant and the skew variant pair S364K/E357Q: L368D/K370S.

In the bivalent ncIL-15/Rα-Fc format, a preferred embodiment utilizes the IL-15 N4D/N65D variant, the skew variant pair S364K/E357Q: L368D/K370S and the 428L/434S variants on each Fc monomer.

In the bivalent ncIL-15/Rα-Fc format, a preferred embodiment utilizes the IL-15 N1D/N65D variant.

In the bivalent ncIL-15/Rα-Fc format, a preferred embodiment utilizes the IL-15 N1D/N65D variant and the skew variant pair S364K/E357Q: L368D/K370S.

In the bivalent ncIL-15/Rα-Fc format, a preferred embodiment utilizes the IL-15 N1D/N65D variant, the skew variant pair S364K/E357Q: L368D/K370S and the 428L/434S variants on each Fc monomer.

In the bivalent ncIL-15/Rα-Fc format, preferred embodiments are shown in FIG. 104AR (XENP24342 including chain 1 and chain 2) and (XENP24346 including chain 1 and chain 2).

VI. Useful Embodiments of the Invention

As will be appreciated by those in the art and discussed more fully below, the heterodimeric fusion proteins of the present invention can take on a wide variety of configurations, as are generally depicted in FIGS. 9A-9G and FIGS. 39A-39D. The amino acid sequences of exemplary fusion proteins are provided in 8A-8E, 10, 11, 12A, 12B, 13-15, 40A, 40B, 41A, 41B, 42, 43, 48A-48D, 49A-49C, 50A, 50B, 51, 52, 53, and 94A-94D.

Many of the embodiments outlined herein rely in general on the format comprising a first monomer (first fusion protein) comprising an IL-15 protein domain covalently attached using a first domain linker to the N-terminus of a first Fc domain, and a second monomer (second fusion protein) comprising an IL-15Rα protein domain covalently attached using a second domain linker to the N-terminus of a second Fc domain. Exemplary embodiments of this format ("IL-15/Rα hetero Fc" and "dsIL-15/Rα hetero Fc") include, but are not limited to, XENP20818, XENP20819, XENP21471, XENP21472, XENP21473, XENP21474, XENP21475, XENP21476, XENP21477, XENP22013, XENP22815, XENP22816, XENP22817, XENP22818, XENP22819, XENP22820, XENP22821, XENP22822, XENP22823, XENP22824, XENP22825, XENP22826, XENP22827, XENP22828, XENP22829, XENP22830, XENP22831, XENP22832, XENP22833, XENP22834, XENP22815, XENP22816, XENP22817, XENP22818, XENP22819, XENP22820, XENP22821, XENP23343, XENP23554, XENP23555, XENP23557, XENP23559, XENP23561, XENP24018, XENP24019, XENP24020, XENP24051, XENP24052, XENP23504, XENP24306, XENP24306, XENP23343, XENO24113, XENP24341, and XENP24301.

A useful format of a heterodimer Fc fusion protein comprises a fusion protein comprising a first protein domain covalently attached to the N-terminus of a second protein domain via a first domain linker that is covalently attached to the N-terminus of a first Fc domain via a second domain linker, and a second Fc domain (e.g., an empty Fc domain). In some cases, the first protein domain is an IL-15Rα protein domain and the second protein domain is an IL-15 protein domain. An exemplary embodiment of this format ("scIL-15/Rα-Fc") includes, but is not limited to, XENP21478.

Yet another useful of a heterodimer Fc fusion protein outlined herein comprises a fusion protein comprising a first protein domain covalently attached to the N-terminus a first Fc domain via a domain linker, a second Fc domain (e.g., an empty Fc domain), and a second protein domain that is noncovalently attached to the first protein domain. In some cases, the first protein domain is an IL-15 protein domain and the second protein domain is an IL-15Rα protein domain. An exemplary embodiment of this format ("ncIL-15/Rα-Fc" or "dsIL-15/Rα-Fc") includes, but is not limited to, XENP21479, XENP22357, XENP22354, XENP22355, XENP22356, XENP22357, XENP22358, XENP22359, XENP22360, XENP22361, XENP22362, XENP22363, XENP22364, XENP22365, XENP22366, XENP22637, XENP24348, XENP24349, and XENP24383.

Another useful format of a heterodimer Fc fusion protein outlined herein comprises a first fusion protein comprising a first protein domain covalently attached to the N-terminus of said first Fc domain via a first domain linker, a second fusion protein comprising a second protein domain covalently attached to the N-terminus of said second Fc domain via a second domain linker, a third protein domain noncovalently attached to said first protein domain of said first fusion protein, and a fourth protein domain noncovalently attached to said second protein domain of said second fusion protein. In some cases, the first and second protein domains are IL-15 Rα protein domains, and the third and fourth protein domains are IL-15 protein domains. An exemplary embodiment of this format ("bivalent ncIL-15/Rα-Fc" or "bivalent dsIL-15/Rα-Fc") includes, but is not limited to, XENP21978, XENP22634, XENP24342, and XENP24346.

Another useful format ("bivalent scIL-15/Rα-Fc") is outlined herein in FIG. 14.

Yet another useful format of a heterodimer Fc fusion protein outlined herein comprises a first fusion protein comprising a first Fc domain covalently attached to the N-terminus of a first protein domain using a domain linker, a second Fc domain (e.g., an empty Fc domain), and a second protein domain noncovalently attached to said first protein domain. An exemplary embodiment of this format ("Fc-ncIL-15/Rα" or "Fc-dsIL-15/Rα") includes, but is not limited to, XENP22637 and XENP22639, and those depicted in FIG. 16. In some embodiments, the first protein and the second protein are attached via a linker (FIG. 9G).

For any of the heterodimer Fc fusion proteins outlined herein, the first domain linker and the second domain linker can be the same or different. In addition, the first Fc domain and the second Fc domain of the heterodimeric protein can have different amino acid sequences.

The Fc domains of the present invention comprise IgG Fc domains, e.g., IgG1 Fc domains. In some embodiments, the first and second Fc domains comprising a set of amino acid substitutions selected from the group consisting of: L368D/K370S and S364K; L368D/K370S and S364K/E357L; L368D/K370S and S364K/E357Q; T411E/K360E/Q362E and D401K; L368E/K370S and S364K; K370S and S364K/E357Q; K370S and S364K/E357Q; S267K/L368D/K370S and S267K/S364K/E357Q, according to EU numbering. In some instances, the first and/or the second Fc domains of any of the heterodimeric Fc fusion formats outlined herein can have an additional set of amino acid substitutions comprising Q295E/N384D/Q418E/N421D, according to EU numbering. In some embodiments, the first and/or the second Fc domains have an additional set of amino acid substitutions consisting of: G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

Additional heterodimerization variants can be independently and optionally included and selected from variants outlined in the figures. These compositions can further comprise ablation variants, pI variants, charged variants, isotypic variants, etc.

VII. Nucleic Acids of the Invention

The invention further provides nucleic acid compositions encoding the heterodimeric Fc fusion protein of the invention (or, in the case of a monomer Fc domain protein, nucleic acids encoding those as well).

As will be appreciated by those in the art, the nucleic acid compositions will depend on the format of the heterodimeric protein. Thus, for example, when the format requires three amino acid sequences, three nucleic acid sequences can be incorporated into one or more expression vectors for expression. Similarly, some formats only two nucleic acids are needed; again, they can be put into one or two expression vectors.

As is known in the art, the nucleic acids encoding the components of the invention can be incorporated into expression vectors as is known in the art, and depending on the host cells used to produce the heterodimeric Fc fusion proteins of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer, as applicable depending on the format, are each contained within a single expression vector, generally under different or the same promoter controls. In embodiments of particular use in the present invention, each of these two or three nucleic acids are contained on a different expression vector.

The heterodimeric Fc fusion protein of the invention are made by culturing host cells comprising the expression vector(s) as is well known in the art. Once produced, traditional fusion protein or antibody purification steps are done, including an ion exchange chromatography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the heterodimer (e.g., anionic exchange columns, cationic exchange columns). These substitutions also aid in the determination and monitoring of any contaminating homodimers post-purification (e.g., IEF gels, cIEF, and analytical IEX columns).

VIII. Biological and Biochemical Functionality of IL-15/IL15Rα Heterodimeric Immunomodulatory Fc Fusion Proteins Generally the heterodimeric Fc fusion proteins of the invention are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g., presence of ICOS+ CD4+ T cells following ipi treatment) along with "old fashioned" measurements such as tumor burden, size, invasiveness, LN involvement, metastasis, etc. can be done. Thus, any or all of the following can be evaluated: the inhibitory effects of PVRIG on $CD4^+$ T cell activation or proliferation, $CD8^+$ T (CTL) cell activation or proliferation, $CD8^+$ T cell-mediated cytotoxic activity and/or CTL mediated cell depletion, NK cell activity and NK mediated cell depletion, the potentiating effects of PVRIG on Treg cell differentiation and proliferation and Treg- or myeloid derived suppressor cell (MDSC)-mediated immunosuppression or immune tolerance, and/or the effects of PVRIG on proinflammatory cytokine production by immune cells, e.g., IL-2, IFN-γ or TNF-α production by T or other immune cells.

In some embodiments, assessment of treatment is done by evaluating immune cell proliferation, using for example, CFSE dilution method, Ki67 intracellular staining of immune effector cells, and $^3$H-thymidine incorporation method, In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In general, gene expression assays are done as is known in the art.

In general, protein expression measurements are also similarly done as is known in the art.

In some embodiments, assessment of treatment is done by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, $^{51}$Cr or $^{35}$S release method, LDH activity, MTT and/or WST assays, Calcein-AM assay, Luminescent based assay, and others.

In some embodiments, assessment of treatment is done by assessing T cell activity measured by cytokine production, measure either intracellularly in culture supernatant using cytokines including, but not limited to, IFNγ, TNFα, GM-CSF, IL2, IL6, IL4, IL5, IL10, IL13 using well known techniques.

Accordingly, assessment of treatment can be done using assays that evaluate one or more of the following: (i) increases in immune response, (ii) increases in activation of and/or γδ T cells, (iii) increases in cytotoxic T cell activity, (iv) increases in NK and/or NKT cell activity, (v) alleviation of and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells (Tregs).

A. Assays to Measure Efficacy

In some embodiments, T cell activation is assessed using a Mixed Lymphocyte Reaction (MLR) assay as is known in the art. An increase in activity indicates immunostimulatory activity. Appropriate increases in activity are outlined below.

In one embodiment, the signaling pathway assay measures increases or decreases in immune response as measured for an example by phosphorylation or de-phosphorylation of different factors, or by measuring other post translational modifications. An increase in activity indicates immunostimulatory activity. Appropriate increases in activity are outlined below.

In one embodiment, the signaling pathway assay measures increases or decreases in activation of αβ and/or γδ T cells as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in αβ and/or γδ T-cell suppression, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-γ production as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers.

A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in $\alpha\beta$ and/or $\gamma\delta$ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases $\alpha\beta$ and/or $\gamma\delta$ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7 etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases in stimulation of cytotoxic or cytostatic effect on cancer cells, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by proliferation or by changes in expression of activation markers like for an example CD137, CD107a, PD1, etc. For T-cells, increases in proliferation, cell surface markers of activation (e.g., CD25, CD69, CD137, PD1), cytotoxicity (ability to kill target cells), and cytokine production (e.g., IL-2, IL-4, IL-6, IFN$\gamma$, TNF-a, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g., IFN$\gamma$ and TNF), and cell surface receptor expression (e.g. CD25) would be indicative of immune modulation that would be consistent with enhanced killing of cancer cells.

In one embodiment, $\gamma\delta$ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of 10%, 20%, 30%, 40%, 50%, 60%, 70%, 80%, 90%, 95% or 98 to 99% percent over the signal in either a reference sample or in control samples, for example test samples that do not contain an anti-PVRIG antibody of the invention. Similarly, increases of at least one-, two-, three-, four- or five-fold as compared to reference or control samples show efficacy.

IX. Treatments

Once made, the compositions of the invention find use in a number of oncology applications, by treating cancer, generally by promoting T cell activation (e.g., T cells are no longer suppressed) with the binding of the heterodimeric Fc fusion proteins of the invention.

Accordingly, the heterodimeric compositions of the invention find use in the treatment of these cancers.

A. Heterodimeric Protein Compositions for In Vivo Administration

Formulations of the antibodies used in accordance with the present invention are prepared for storage by mixing an antibody having the desired degree of purity with optional pharmaceutically acceptable carriers, excipients or stabilizers (as generally outlined in Remington's Pharmaceutical Sciences 16th edition, Osol, A. Ed. [1980]), in the form of lyophilized formulations or aqueous solutions. Acceptable carriers, buffers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

B. Administrative Modalities

The heterodimeric proteins and chemotherapeutic agents of the invention are administered to a subject, in accord with known methods, such as intravenous administration as a bolus or by continuous infusion over a period of time.

C. Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the bispecific antibodies used in the present invention depend on the disease or condition to be treated and may be determined by the persons skilled in the art.

An exemplary, non-limiting range for a therapeutically effective amount of an bispecific antibody used in the present invention is about 0.1-100 mg/kg.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in US Publications 2015/0307629, 2014/0288275 and WO2014/145806, all of which are expressly incorporated by reference in their entirety and particularly for the techniques outlined therein.

X. Example 1: IL-15/IL-15Rα(Sushi) Fc Fusion Proteins

In order to address the short half-life of IL-15/IL-15Rα heterodimers, we generated the IL-15/IL-15Rα(sushi) complex as a Fc fusion (hereon referred to as IL-15/Rα-Fc fusion proteins) with the goal of facilitating production and promoting FcRn-mediated recycling of the complex and prolonging half-life.

A. Example 1A: Engineering IL-15/Rα-Fc Fusion Proteins

Plasmids coding for IL-15 or IL-15Rα sushi domain were constructed by standard gene synthesis, followed by subcloning into a pTT5 expression vector containing Fc fusion partners (e.g., constant regions as depicted in FIG. 8). Cartoon schematics of illustrative IL-15/Rα-Fc fusion protein formats are depicted in FIGS. 9A-G.

The IL-15Rα heterodimeric Fc fusion or "IL-15/Rα-heteroFc" format comprises IL-15 recombinantly fused to one side of a heterodimeric Fc and IL-15Rα sushi domain recombinantly fused to the other side of the heterodimeric Fc (FIG. 9A). The IL-15 and IL-15Rα may have a variable length linker (see FIG. 7) between their respective C-terminus and the N-terminus of the Fc region. Illustrative proteins of this format include XENP20818 and XENP21475, sequences for which are depicted in FIG. 10 (see also Table 1). Sequences for additional proteins of this format are listed as XENPs 20819, 21471, 21472, 21473, 21474, 21476, and 21477 in the figures and in the sequence listing.

TABLE 1

| XENP | IL-15-Fc Linker | IL-15Rα(sushi)-Fc Linker |
|---|---|---|
| 20818 | (GGGGS)$_1$ (SEQ ID NO: 14) | (GGGGS)$_1$ (SEQ ID NO: 14) |
| 20819 | (GGGGS)$_1$ (SEQ ID NO: 14) | (GGGGS)$_4$ (SEQ ID NO: 17) |
| 21471 | NONE | (GGGGS)$_1$ (SEQ ID NO: 14) |
| 21472 | (GGGGS)$_1$ (SEQ ID NO: 14) | NONE |
| 21473 | (GGGGS)$_1$ (SEQ ID NO: 14) | (GGGGS)$_3$ (SEQ ID NO: 16) |
| 21474 | NONE | (GGGGS)$_4$ (SEQ ID NO: 17) |
| 21475 | NONE | NONE |
| 21476 | (GGGGS)$_2$ (SEQ ID NO: 15) | (GGGGS)$_2$ (SEQ ID NO: 15) |
| 21477 | (GGGGS)$_2$ (SEQ ID NO: 15) | (GGGGS)$_4$ (SEQ ID NO: 17) |

The single-chain IL-15/Rα-Fc fusion or "scIL-15/Rα-Fc" format comprises IL-15Rα sushi domain fused to IL-15 by a variable length linker (termed a "single-chain" IL-15/IL-15Rα complex or "scIL-15/Rα") which is then fused to the N-terminus of a heterodimeric Fc-region, with the other side of the molecule being a "Fc-only" or "empty-Fc" heterodimeric Fc (FIG. 9B). Sequences for illustrative linkers are depicted in FIG. 7. An illustrative protein of this format is XENP21478, sequences for which are depicted in FIG. 11 (also see Table 2). Sequences for additional proteins of this format are listed as XENPs 21993, 21994, 21995, 23174, 23175, 24477, and 24480 in the figures and the sequence listing.

TABLE 2

| XENP | Linker between IL-15 and IL-15Rα |
|---|---|
| 21478 | (GGGGS)$_6$ (SEQ ID NO: 19) |
| 21993 | (GGGGS)$_5$ (SEQ ID NO: 18) |
| 21994 | (GGGGS)$_4$ (SEQ ID NO: 17) |
| 21995 | (GGGGS)$_3$ (SEQ ID NO: 16) |
| 23174 | (GKPGS)$_6$ (SEQ ID NO: 24) |
| 23175 | (GKPGS)$_5$ (SEQ ID NO: 23) |
| 24477 | (GGGGS)$_7$ (SEQ ID NO: 20) |
| 24480 | 30AA-linker |

The non-covalent IL-15/Rα-Fc fusion or "ncIL-15/Rα-Fc" format comprises IL-15Rα sushi domain fused to a heterodimeric Fc region, while IL-15 is transfected separately so that a non-covalent IL-15/IL-15Rα complex is formed, with the other side of the molecule being a "Fc-only" or "empty-Fc" heterodimeric Fc (FIG. 9C). Illustrative proteins of this format include XENP21479, XENP22366 and XENP24348, sequences for which are depicted in FIG. 12.

The bivalent non-covalent IL-15/Rα-Fc fusion or "bivalent ncIL-15/Rα-Fc" format (FIG. 9D) comprises IL-15Rα (sushi) fused to the N-terminus of a homodimeric Fc region, while IL-15 is transfected separately so that a non-covalent IL-15/Rα complex is formed. An illustrative protein of this format is XENP21978, sequences for which are depicted in FIG. 13. Sequences for additional proteins of this format are listed as XENP21979 in the figures and in the sequence listing.

The bivalent single-chain IL-15/Rα-Fc fusion or "bivalent scIL-15/Rα-Fc" format (FIG. 9E) comprises IL-15 fused to IL-15Rα(sushi) by a variable length linker (termed a "single-chain" IL-15/IL-15Rα(sushi) complex or "scIL-15/Rα") which is then fused to the N-terminus of a homodimeric Fc-region. Sequences for illustrative linkers are depicted in FIG. 7. Sequences for an illustrative protein of this format are depicted in FIG. 14.

The Fc-non-covalent IL-15/Rα fusion or "Fc-ncIL-15/Rα" format (FIG. 9E) comprises IL-15Rα(sushi) fused to the C-terminus of a heterodimeric Fc region, while IL-15 is transfected separately so that a non-covalent IL-15/Rα complex is formed, with the other side of the molecule being "Fc-only" or "empty Fc". An illustrative protein of this format is XENP22637, sequences for which are depicted in FIG. 15. Sequences for additional proteins of this format are listed XENP22638 in the figures and the sequence listing.

The Fc-single-chain IL-15/Rα fusion or "Fc-scIL-15/Rα" format (FIG. 9G) comprises IL-15 fused to IL-15Rα(sushi) by a variable length linker ("scIL-15/Rα") which is then fused to the C-terminus of a heterodimeric Fc region, with the other side of the molecule being "Fc-only" or "empty Fc". Sequences for illustrative linkers are depicted in FIG. 7. Sequences for an illustrative protein of this format are depicted in FIG. 16.

Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

B. Example 1B: Engineering IL-15/Rα-Fc Fusion Proteins

IL-15/Rα-Fc fusion proteins produced in several of the formats as described above were characterized by size-exclusion chromatography (SEC) and capillary isoelectric focusing (CEF) for purity and homogeneity as generally described below.

Figure 17A:
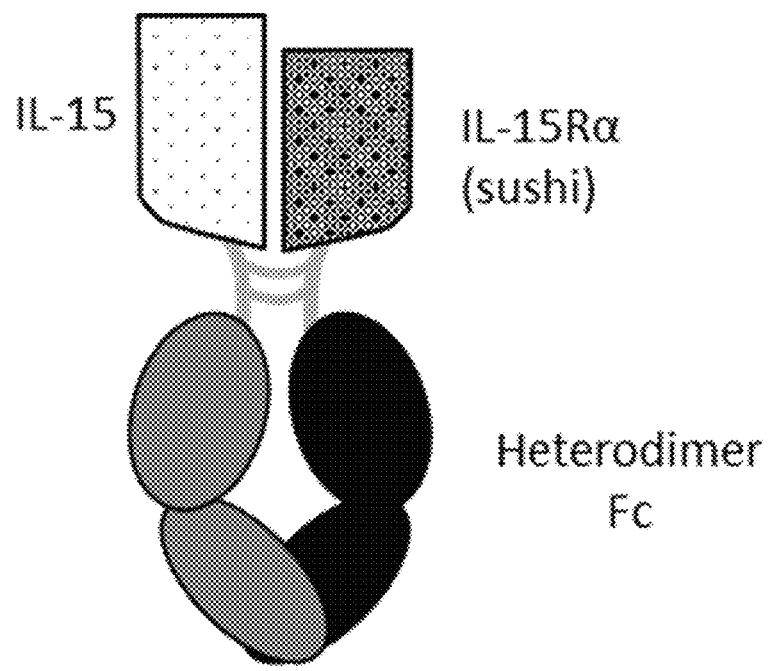
Figure 17B:
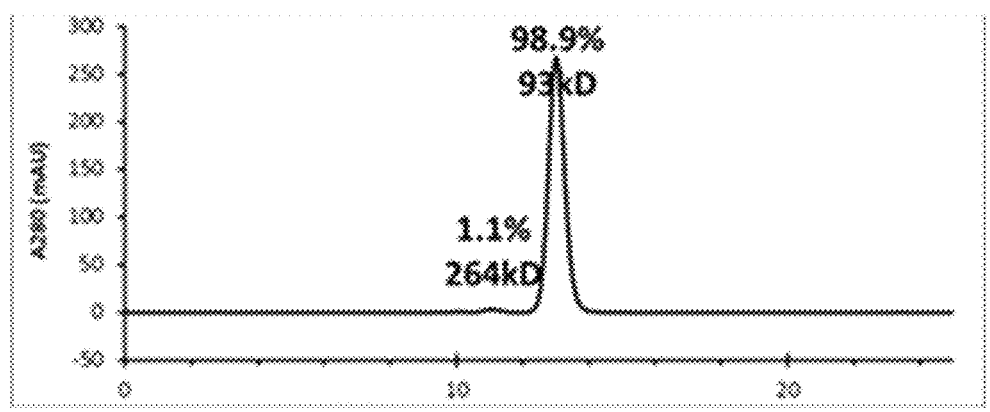
Figure 18A:
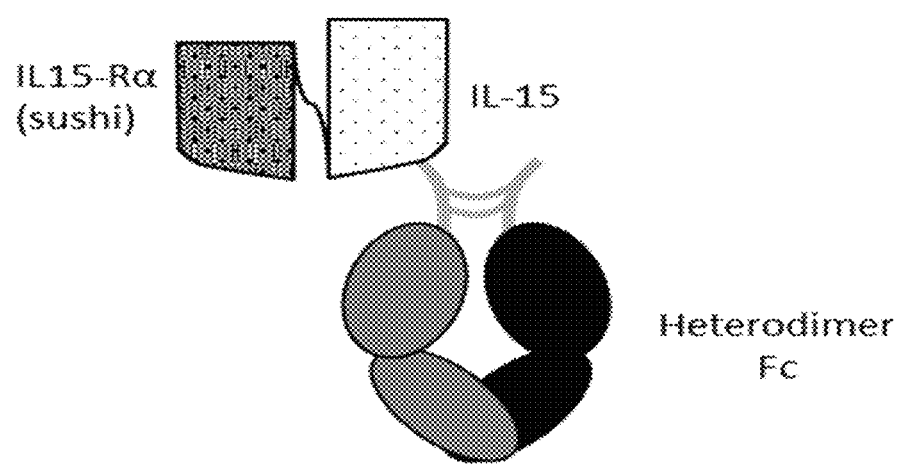
Figure 18B:
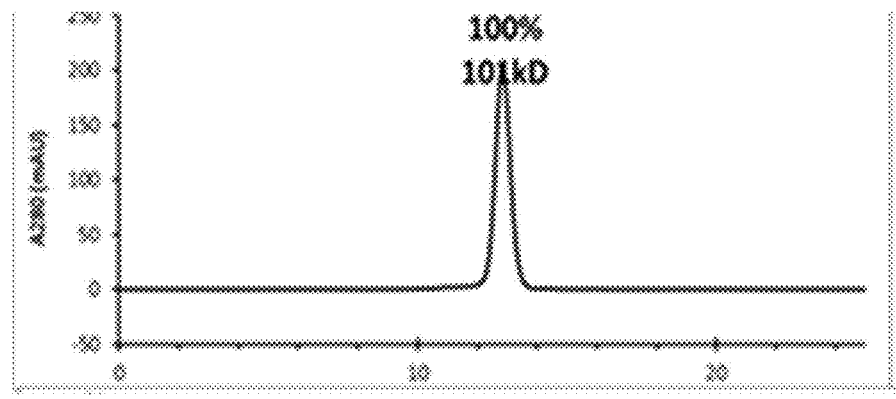
Figure 19A:
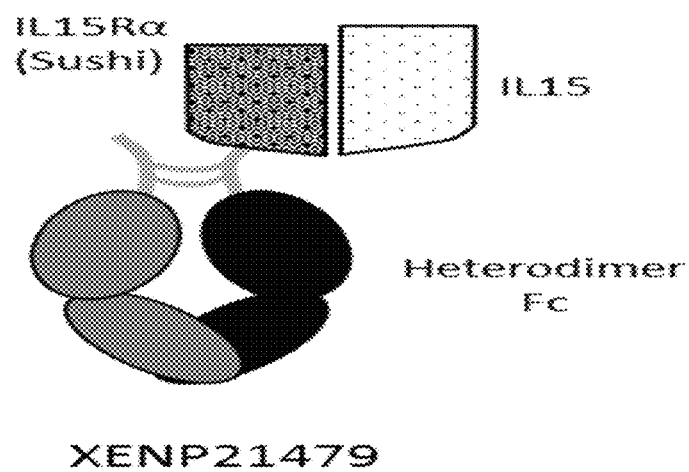
Figure 19B:
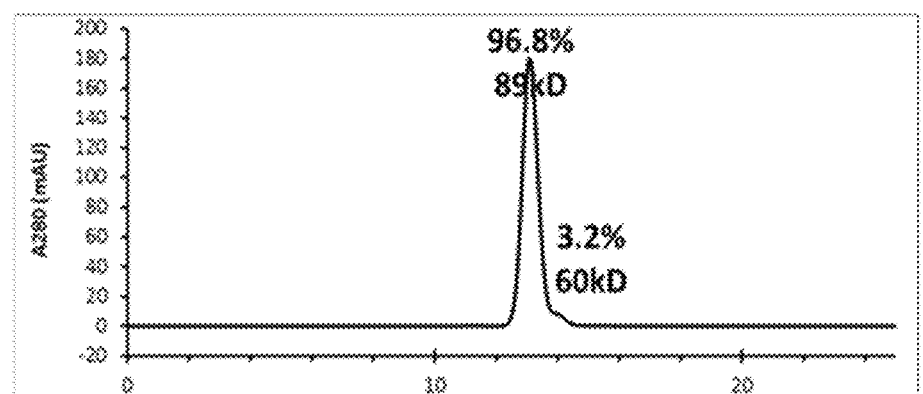

The proteins were analyzed using SEC to measure their size (i.e. hydrodynamic volume) and determine the native-like behavior of the purified samples. The analysis was performed on an Agilent 1200 high-performance liquid chromatography (HPLC) system. Samples were injected onto a Superdex™ 200 10/300 GL column (GE Healthcare Life Sciences) at 1.0 mL/min using 1×PBS, pH 7.4 as the mobile phase at 4° C. for 25 minutes with UV detection wavelength at 280 nM. Analysis was performed using Agilent OpenLab Chromatography Data System (CDS) ChemStation Edition AIC version C.01.07. Chromatograms for selected IL-15/Rα-Fc fusion proteins are shown in FIGS. 17B, 18B, and 19B.

Figure 17C:
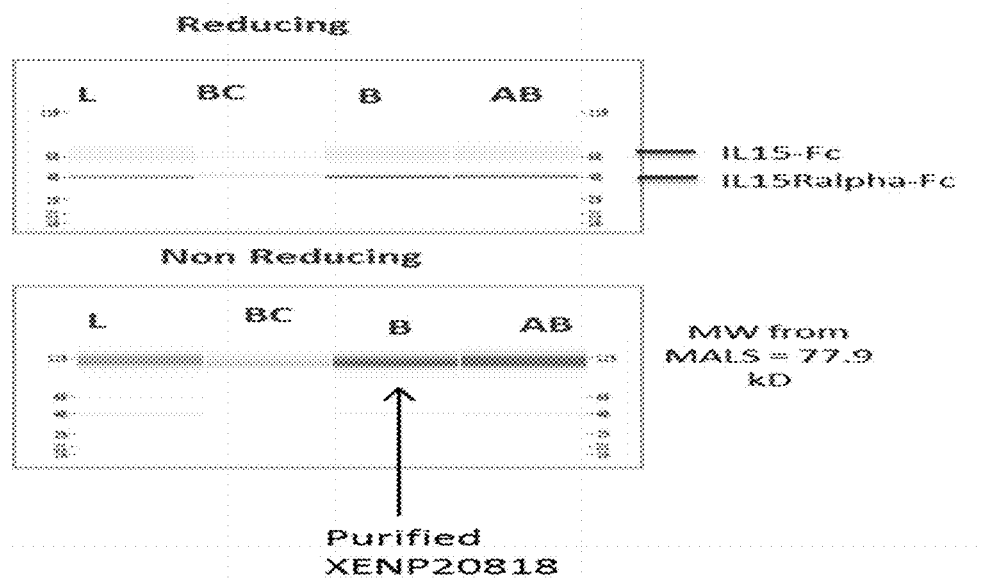
Figure 18C:
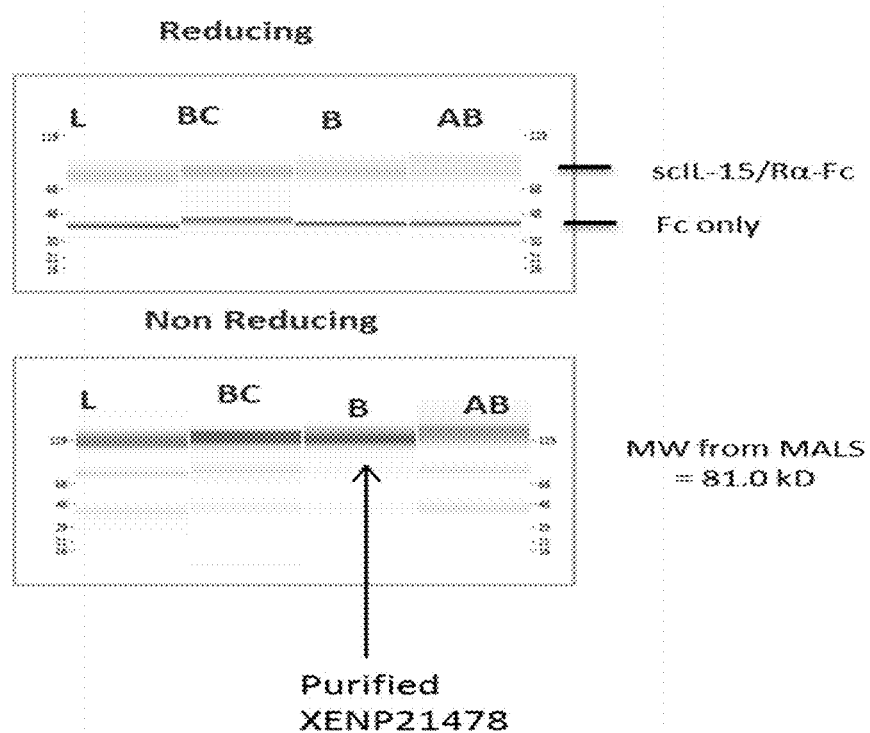
Figure 19C:
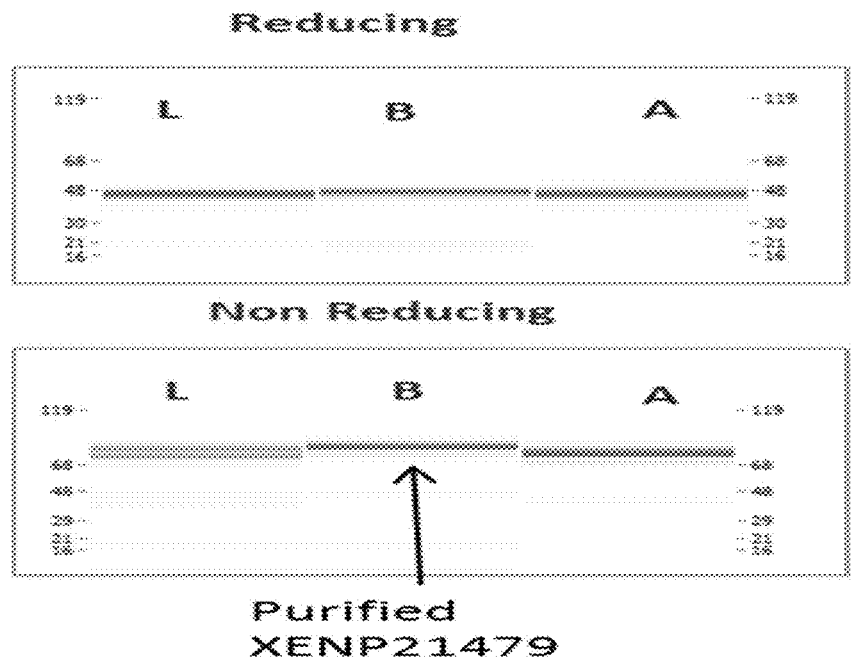

The proteins were analyzed electrophoretically via CEF using LabChip GXII Touch HT (PerkinElmer, Waltham, Mass.) using Protein Express Assay LabChip and Protein Express Assay Reagent Kit carried out using the manufacturer's instructions. Samples were run in duplicate, one under reducing (with dithiothreitol) and the other under non-reducing conditions. Gel images for selected IL-15/Rα-Fc fusion proteins are shown in FIGS. 17C, 18C, and 19C.

The symmetry of the peaks and the relatively low populations of other species for each of the fusion proteins indicate that the various formats were robust.

Figure 17D:
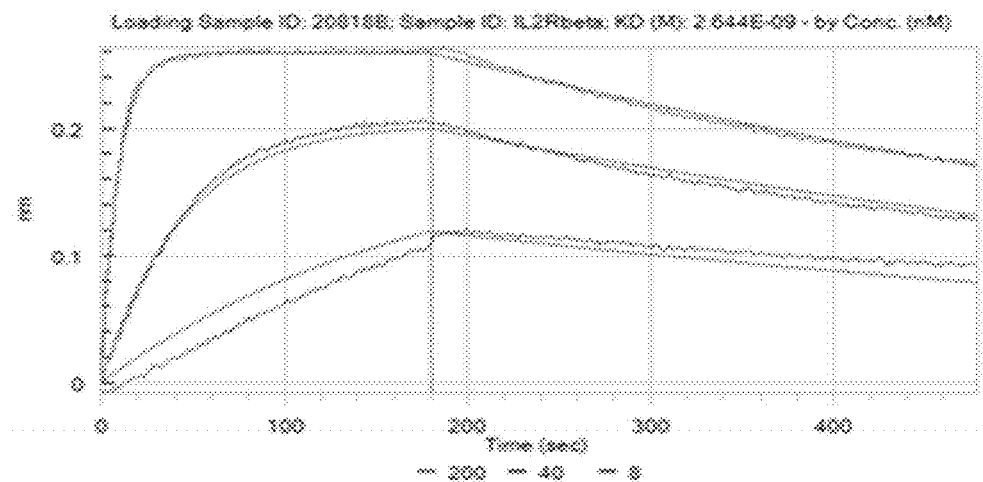
Figure 18D:
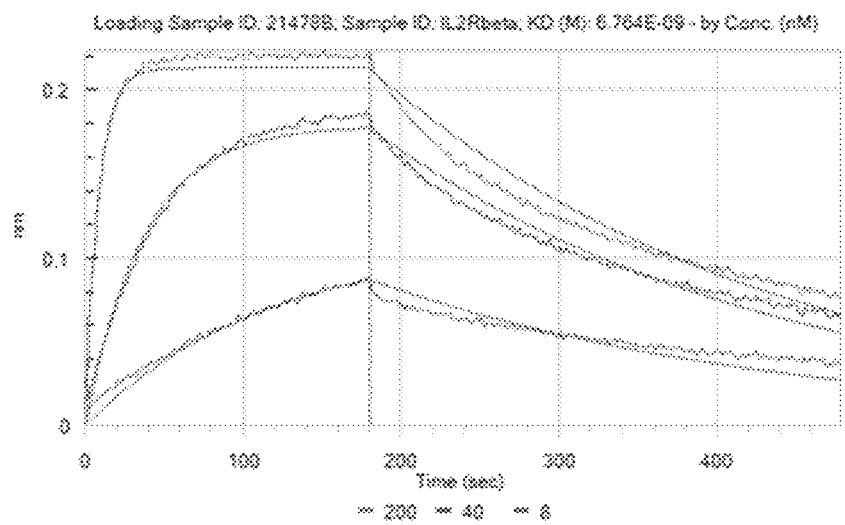
Figure 19D:
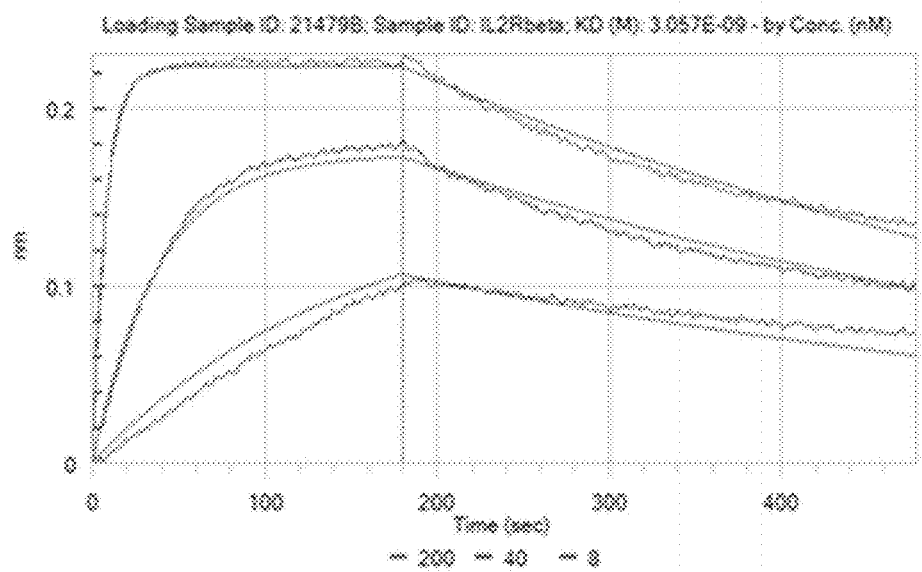

C. Example 1C: Characterization of IL-15/Rα-Fc Fusion Proteins for Affinity and Stability Affinity screens of IL-15/Rα-Fc fusion proteins were performed using Octet, a BioLayer Interferometry (BLI)-based method. Experimental steps for Octet generally included the following: Immobilization (capture of ligand or test article onto a biosensor); Association (dipping of ligand- or test article-coated biosensors into wells containing serial dilutions of the corresponding test article or ligand); and Dissociation (returning of biosensors to well containing buffer) in order to determine the affinity of the test articles. A reference well containing buffer alone was also included in the method for background correction during data processing. In particular, anti-human Fc (AHC) biosensors were used to capture the test articles and then dipped into multiple concentration of IL-2Rβ (R&D Systems, Minneapolis, Minn.) for KD determination. The affinity results and corresponding sensorgrams are depicted in FIGS. 17D, 18D, and 19D. Each of the three constructs showed high affinity binding (3-8 nM) for IL-1Rβ.

Figure 17E:
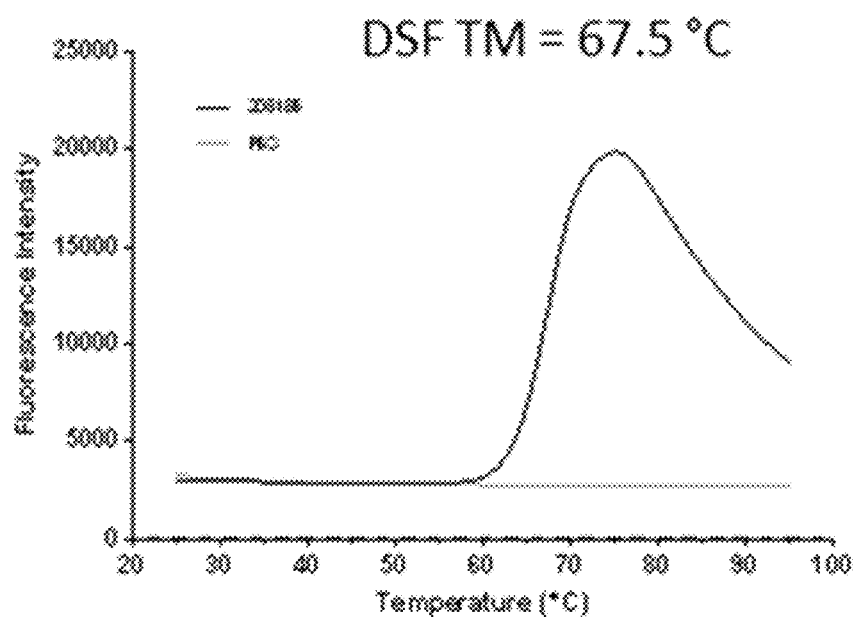
Figure 18E:
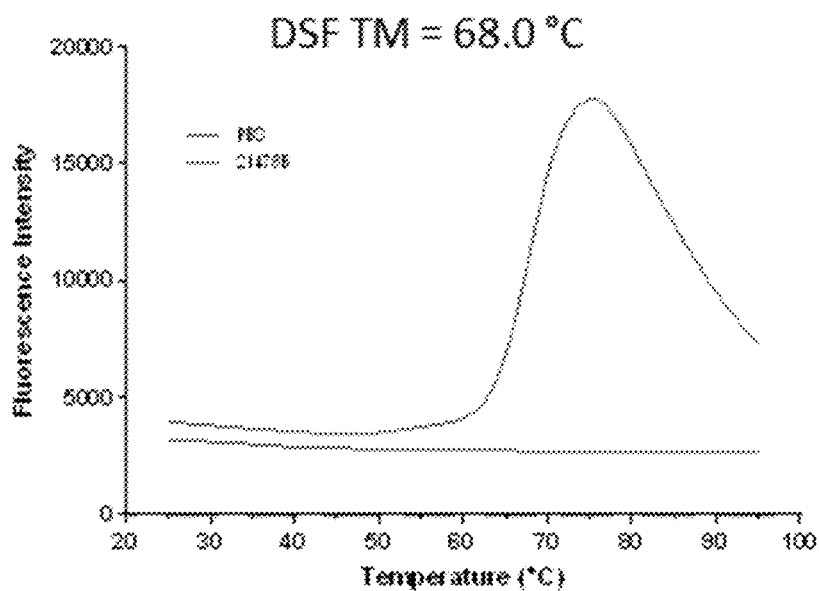
Figure 19E:
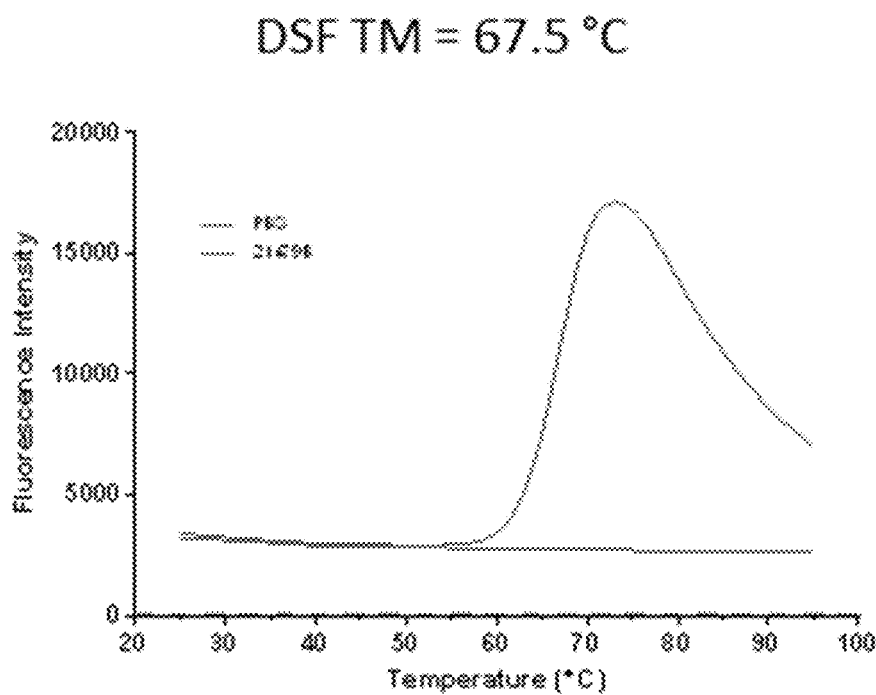

Stability of IL-15/Rα-Fc fusion proteins were evaluated using Differential Scanning Fluorimetry (DSF). DSF experiments were performed using a Bio-Rad CFX Connect Real-Time PCR Detection System. Proteins were mixed with SYPRO Orange fluorescent dye and diluted to 0.2 mg/mL in PBS. The final concentration of SYPRO Orange was 10×. After an initial 10 minute incubation period at 25° C., proteins were heated from 25 to 95° C. using a heating rate of 1° C./min. A fluorescence measurement was taken every 30 sec. Melting temperatures (Tm) were calculated using the instrument software. The stability results and corresponding melting curves are depicted in FIGS. 17E, 18E, and 19E. Each of the constructs showed favorable overall stability with Tm ~68° C.

D. Example 1D: Activity of IL-15/Rα-Fc Fusion Proteins in Cell Proliferation Assays IL-15/Rα-Fc fusion proteins in the various formats as described above were tested in a cell proliferation assay. Human PBMCs were treated with the test articles at the indicated concentrations. 4 days after treatment, the PBMCs were stained with anti-CD8-FITC (RPA-T8), anti-CD4-PerCP/Cy5.5 (OKT4), anti-CD27-PE (M-T271), anti-CD56-BV421 (5.1H11), anti-CD16-BV421 (3G8), and anti-CD45RA-BV605 (Hi100) to gate for the following cell types: CD4+ T cells, CD8+ T cells, and NK cells (CD56+/CD16+). Ki67 is a protein strictly associated with cell proliferation, and staining for intracellular Ki67 was performed using anti-Ki67-APC (Ki-67) and Foxp3/Transcription Factor Staining Buffer Set (Thermo Fisher Scientific, Waltham, Mass.). The percentage of Ki67 on the above cell types was measured using FACS (depicted in FIGS. 20A-20C and 21A-21C).

The various IL-15/Rα-Fc fusion proteins induced strong proliferation of CD8+ T cells and NK cells. Notably, differences in proliferative activity were dependent on the linker length on the IL-15-Fc side. In particular, constructs having no linker (hinge only), including XENP21471, XENP21474, and XENP21475, demonstrated weaker proliferative activity.

E. Example 1E: Activity of IL-15/Rα-Fc Fusion Proteins in an SEB-Stimulated PBMC Assay As described above, IL-15/Rα heterodimers can potently activate T cells. IL-15/Rα-Fc fusion proteins in the various formats as described above were tested in an SEB-stimulated PBMC assay. Staphylococcal Enterotoxin B (SEB) is a superantigen that causes T cell activation and proliferation in a manner similar to that achieved by activation via the T cell receptor (TCR). Stimulating human PBMC with SEB is a common method for assaying T cell activation and proliferation.

Human PBMCs from multiple donors were stimulated with 10 ng/mL of SEB for 72 hours in combination with 20 µg/mL of various IL-15/Rα-Fc fusion proteins or controls (PBS, an isotype control, and a bivalent anti-PD-1 antibody). After treatment, supernatant was collected and assayed for IL-2, data for which is depicted in FIG. 22. The data clearly show that the IL-15/Rα-Fc fusion proteins enhanced IL-2 secretion more than PBS and isotype control.

Notably, a number of the IL-15/Rα-Fc fusion proteins have activity equivalent to or better than that of the anti-PD-1 antibody.

F. Example 1F: IL-15/Rα-Fc Fusion Proteins Enhance Engraftment and Disease Activity in Human PBMC-Engrafted NSG Mice IL-15/Rα-Fc fusion protein XENP20818 was evaluated in a Graft-versus-Host Disease (GVHD) model conducted in female NSG (NOD-SCID-gamma) immunodeficient mice. When the NSG mice were injected with human PBMCs, the human PBMCs developed an autoimmune response against mouse cells. Treatment of NSG mice injected with human PBMCs followed with IL-15/Rα-Fc fusion proteins enhances proliferation of the engrafted T cells.

10 million human PBMCs were engrafted into NSG mice via IV-OSP on Day 0 followed by dosing of XENP20818 (1 mg/kg on Day 1 and then weekly thereafter) and recombinant IL-15 (Biolegend; 0.17 mg/kg on Day 1 and then weekly thereafter). The survival curve is shown in FIG. 23. The data show that mice receiving the IL-15/Rα-Fc fusion protein demonstrated rapid morbidity and mortality (all dead by Day 10) compared with mice receiving recombinant IL-15 (all alive by Day 14). This is likely due to the expected longer half-life of the IL-15/Rα-Fc fusion protein.

In another experiment, 10 million human PBMCs were engrafted in NSG mice via IV-OSP on Day 0 followed by dosing of XENP20818 (1 mg/kg, 0.3 mg/kg, 0.1 mg/kg, or 0.03 mg/kg on Day 1 and then weekly thereafter) or PBS. Control groups in which mice were not engrafted with PBMCs were included to investigate any effect of XENP20818 on wild-type NSG mice. Blood was collected on Day 7 to measure IFNγ, data for which is depicted in FIG. 24, and to measure CD4+ T cell, CD8+ T cell, and CD45+ cell counts, data for which are depicted in FIG. 25. The data shows a clear dose response for XENP20818.

XI. Example 2: IL-15/Rα-Fc Heterodimeric Fusion Proteins with Engineered Disulfide Bonds To further improve stability and prolong the half-life of IL-15/Rα-Fc fusion proteins, we engineered disulfide bonds into the IL-15/Rα interface.

A. Example 2A: Engineering and Characterization of IL-15/Rα Heterodimers with Engineered Disulfide Bonds By examining the crystal structure of the IL-15/Rα complex, as well as by modeling using Molecular Operating Environment (MOE; Chemical Computing Group, Montreal, Quebec, Canada) software, we predicted residues at the IL-15/Rα interface that may be substituted with cysteine in order to form covalent disulfide bonds, as depicted in FIG. 26.

Plasmids coding for IL-15 or IL-15Rα(sushi) were constructed by standard gene synthesis, followed by subcloning into a pTT5 expression vector. The IL-15Rα(sushi) chain included a C-terminal polyhistidine tag. Residues identified as described above were substituted with cysteines by standard mutagenesis techniques. Additionally, up to three amino acids following the sushi domain in IL-15Rα were added to the C-terminus of IL-15Rα(sushi) as a scaffold for engineering cysteines (illustrative sequences for which are depicted in FIG. 27). Sequences for illustrative IL-15 and IL-15Rα(sushi) variants engineered with cysteines are respectively depicted in FIGS. 28 and 29.

Cartoon schematics of IL-15/Rα heterodimers with and without engineered disulfides are depicted in FIGS. 30A-C. Sequences for an illustrative ncIL-15/Rα heterodimer XENP21996 is depicted in FIG. 31. Sequences for illustrative dsIL-15/Rα heterodimers XENP22004, XENP22005, XENP22006, XENP22008, and XENP22494 are depicted in FIG. 32. Sequences for an illustrative scIL-15/Rα heterodimer are depicted in FIG. 33. "Wild-type" IL-15/Rα heterodimers, with additional residues at the C-terminus but without engineered cysteines, were generated as controls. Sequences for these control IL-15/Rα heterodimers are listed as XENPs 22001, 22002, and 22003 in the figures and the sequence listing. Proteins were produced by transient transfection in HEK293E cells and purified by Ni-NTA chromatography.

After the proteins were purified, they were characterized by capillary isoelectric focusing (CEF) for purity and homogeneity as generally described in Example 1B, gel images for which are depicted in FIGS. 34-35. The proteins were then screened for stability using DSF as generally described in Example 1C, data for which are depicted in FIGS. 36-38. Finally, the proteins were screened for binding to IL-2Rβ by Octet as generally described in Example 1C, data for which is depicted in FIG. 38.

Many of the disulfide bonds were correctly formed as indicated by denaturing non-reducing CEF, where the larger molecular weight of the covalent complex can be seen when compared to the controls without engineered disulfide bonds (FIGS. 34-35). The disulfide bonded IL-15/Rα heterodimers had increased thermostability of up to +13° C. (FIG. 38). Binding to IL-2Rβ was not affected by the inclusion of engineered disulfide bonds (FIG. 38). Favorite disulfide bonded pairs were XENP22005, XENP22006, XENP22008, and XENP22494 and were constructed as Fc fusion proteins as described below.

B. Example 2B: Characterization of IL-15/Rα-Fc Fusion Proteins with Engineered Disulfide Bonds Plasmids coding for IL-15 or IL-15Rα sushi domain with the above-described mutations were subcloned into a pTT5 expression vector containing Fc fusion partners (e.g., constant regions as depicted in FIG. 8). Cartoon schematics of IL-15/Rα-Fc fusion proteins with engineered disulfide bonds are depicted in FIGS. 39A-D.

Disulfide-bonded IL-15/Rα heterodimeric Fc fusion or "dsIL-15/Rα-heteroFc" (FIG. 39A) is the same as "IL-15/Rα-heteroFc", but wherein IL-15Rα(sushi) and IL-15 are further covalently linked as a result of engineered cysteines. Illustrative proteins of this format include XENP22013, XENP22014, XENP22015, and XENP22017, sequences for which are depicted in FIG. 40.

Disulfide-bonded IL-15/Rα Fc fusion or "dsIL-15/Rα-Fc" (FIG. 39B) is the same as "ncIL-15/Rα-Fc", but wherein IL-15Rα(sushi) and IL-15 are further covalently linked as a result of engineered cysteines. Illustrative proteins of this format include XENP22357, XENP22358, XENP22359, XENP22684, and XENP22361, sequences for which are depicted in FIG. 41. Sequences for additional proteins of this format are listed as XENPs 22360, 22362, 22363, 22364, 22365, and 22366 in the figures and the sequence listing.

Bivalent disulfide-bonded IL-15/Rα-Fc or "bivalent dsIL-15/Rα-Fc" (FIG. 39C) is the same as "bivalent ncIL-15/Rα-Fc", but wherein IL-15Rα(sushi) and IL-15 are further covalently linked as a result of engineered cysteines. Illustrative proteins of this format include XENP22634, XENP22635, and XENP22636, sequences for which are depicted in FIG. 42. Sequences for additional proteins of this format are listed as XENP22687 in the figures and the sequence listing.

Fc-disulfide-bonded IL-15/Rα fusion or "Fc-dsIL-15/Rα" (FIG. 39D) is the same as "Fc-ncIL-15/Rα", but wherein IL-15Rα(sushi) and IL-15 are further covalently linked as a result of engineered cysteines. Illustrative proteins of this format include XENP22639 and XENP22640, sequences for which are depicted in FIG. 43.

"Wild-type" IL-15/Rα-Fc fusion proteins, with additional residues at the C-terminus but without engineered cysteines, were generated as controls. Sequences for these control IL-15/Rα-Fc fusion proteins are listed as XENPs 21988, 21989, 21990, 21991, 21992, 22354, 22355, and 22356 in the figures and the sequence listing.

Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

After the proteins were purified, they were characterized by capillary isoelectric focusing (CEF) for purity and homogeneity as generally described in Example 1B. As above, many of the disulfide bonds were correctly formed as indicated by denaturing non-reducing CEF, where the larger molecular weight of the covalent complex can be seen when compared to the controls without engineered disulfide bonds (FIG. 44).

The proteins were then tested in a cell proliferation assay. IL-15/Rα-Fc fusion proteins (with or without engineered disulfide bonds) or controls were incubated with PBMCs for 4 days. Following incubation, PBMCs were stained with anti-CD4-PerCP/Cy5.5 (RPA-T4), anti-CD8-FITC (RPA-T8), anti-CD45RA-BV510 (HI100), anti-CD16-BV421 (3G8), anti-CD56-BV421 (HCD56), anti-CD27-PE (O323), and anti-Ki67-APC (Ki-67) to mark various cell populations and analyzed by FACS as generally described in Example 1D. Proliferation of NK cells, CD4+ T cells, and CD8+ T cells as indicated by Ki67 expression are depicted in FIGS. 45A-C. Each of the IL-15/Rα-Fc fusion proteins and the IL-15 control induced strong proliferation of NK cells, CD8+ T cells, and CD4+ T cells.

XII. Example 3: IL-15/Rα-Fc Fusion Proteins Engineered for Lower Potency and Increased PK and Half-Life In order to further improve PK and prolong half-life, we reasoned that decreasing the potency of IL-15 would decrease the antigen sink, and thus, increase the half-life.

A. Example 3A: Engineering and Production of Variant IL-15/Rα-Fc Fusion Proteins By examining the crystal structure of the IL-15:IL-2Rβ and IL-15:common gamma chain interfaces, as well as by modeling using MOE software, we predicted residues at these interfaces that may be substituted in order to reduce potency. FIG. 46 depicts a structural model of the IL-15: receptor complexes showing locations of the predicted residues where we engineered isosteric substitutions (in order to reduce the risk of immunogenicity). Sequences for illustrative IL-15 variants engineered for reduced potency are depicted in FIG. 47.

Plasmids coding for IL-15 or IL-15Rα(sushi) were constructed by standard gene synthesis, followed by subcloning into a pTT5 expression vector containing Fc fusion partners (e.g., constant regions as depicted in FIG. 8). Substitutions identified as described above were incorporated by standard mutagenesis techniques. Sequences for illustrative IL-15/Rα-Fc fusion proteins of the "IL-15/Rα-heteroFc" format engineered for reduced potency are depicted in FIG. 48, with additional sequences listed as XENPs 22815, 22816, 22817, 22818, 22819, 22820, 22823, 22824, 22825, 22826, 22827, 22828, 22829, 22830, 22831, 22832, 22833, 22834, 23555, 23559, 23560, 24017, 24020, 24043, and 24048 in the figures and the sequence listing.

Sequences for illustrative IL-15/Rα-Fc fusion proteins of the "scIL-15/Rα-Fc" format engineered for lower potency are depicted in FIG. 49, with additional sequences listed as XENPs 24013, 24014, and 24016 in the figures and the sequence listing. Sequences for illustrative IL-15/Rα-Fc fusion proteins of the "ncIL-15/Rα-Fc" format engineered for lower potency are depicted in FIG. 50. Sequences for illustrative ncIL-15/Rα heterodimers engineered for lower potency are depicted in FIG. 51, with additional sequences listed as XENPs 22791, 22792, 22793, 22794, 22795, 22796, 22803, 22804, 22805, 22806, 22807, 22808, 22809, 22810, 22811, 22812, 22813, and 22814 in the figures and the sequence listing. Sequences for an illustrative IL-15/Rα-Fc fusion protein of the "bivalent ncIL-15/Rα-Fc" format engineered for lower potency are depicted in FIG. 52. Sequences for illustrative IL-15/Rα-Fc fusion proteins of the "dsIL-15/Rα-Fc" format engineered for lower potency are depicted in FIG. 53.

Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

B. Example 3B: In Vitro Activity of Variant IL-15/Rα-heteroFc and scIL-15/Rα-Fc Fusion Proteins Engineered for Decreased Potency The variant IL-15/Rα-Fc fusion proteins were tested in a number of cell proliferation assays.

Figure 54A:
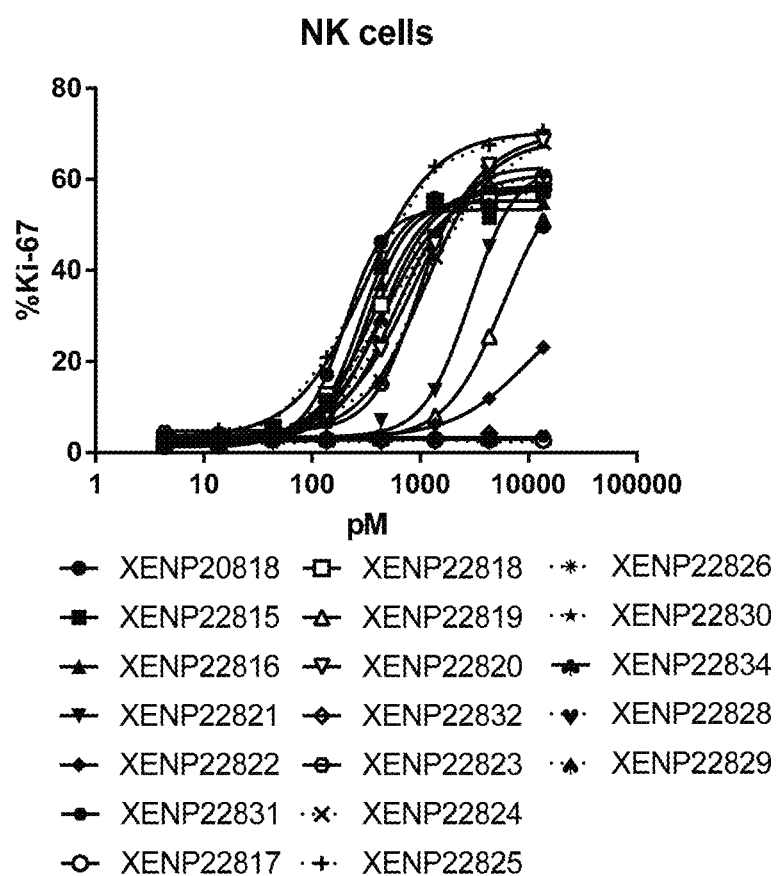
Figure 54B:
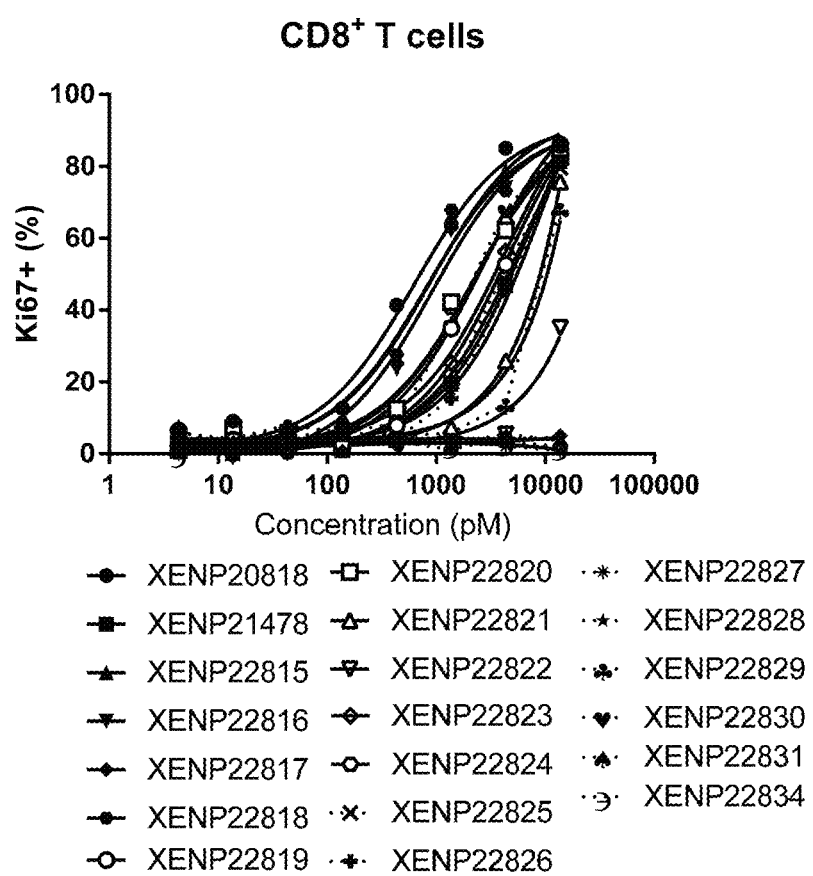
Figure 54C:
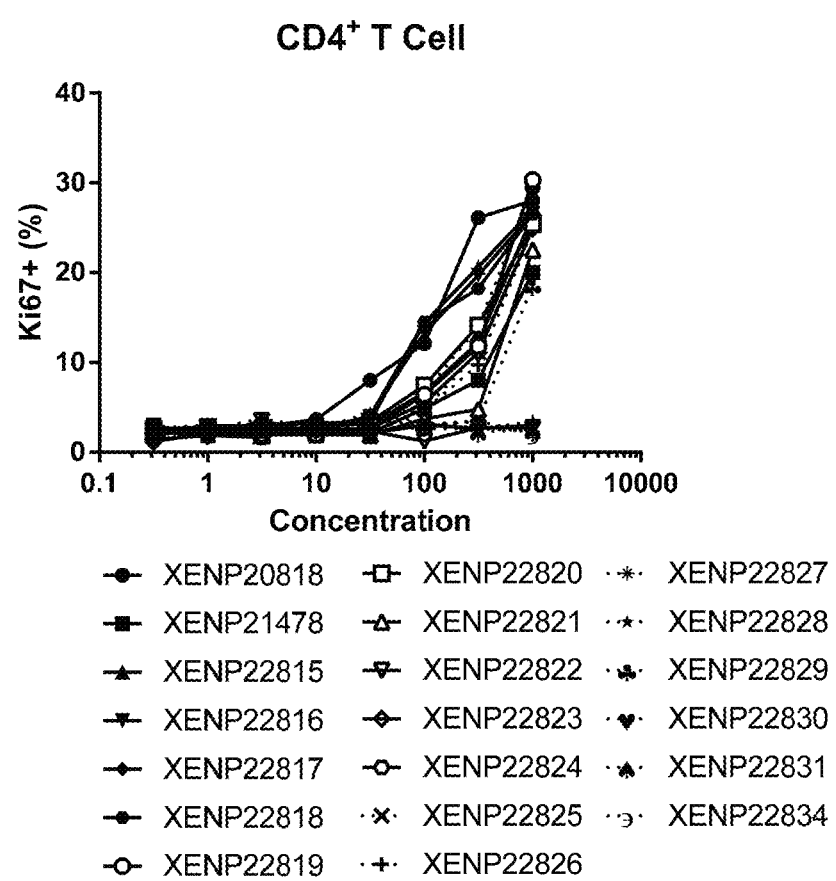

In a first cell proliferation assay, IL-15/Rα-Fc fusion proteins (with or without engineered substitutions) or control were incubated with PBMCs for 4 days. Following incubation, PBMCs were stained with anti-CD4-Evolve605 (SK-3), anti-CD8-PerCP/Cy5.5 (RPA-T8), anti-CD45RA-APC/Cy7 (HI100), anti-CD16-eFluor450 (CB16), anti-CD56-eFluor450 (TULY56), anti-CD3-FITC (OKT3), and anti-Ki67-APC (Ki-67) to mark various cell populations and analyzed by FACS as generally described in Example 1D. Proliferation of NK cells, CD8+ T cells, and CD4+ T cells as indicated by Ki67 expression are depicted in FIGS. 54-55. Most of the IL-15/Rα-Fc fusion proteins induced proliferation of each cell population; however, activity varied depending on the particular engineered substitutions.

Figure 56A:
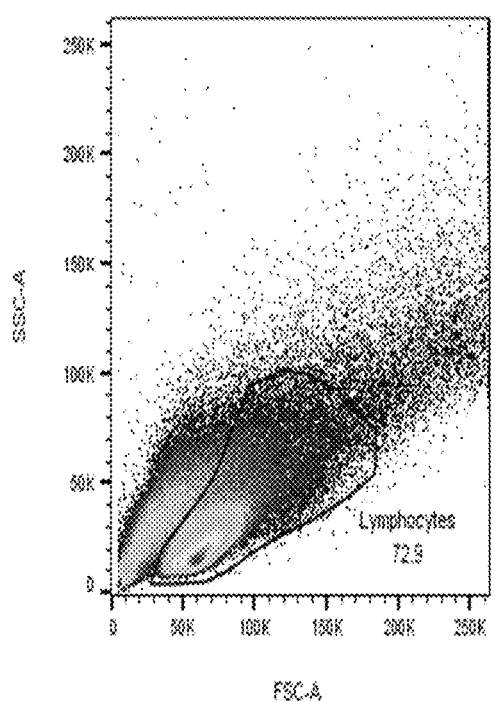
Figure 56B:
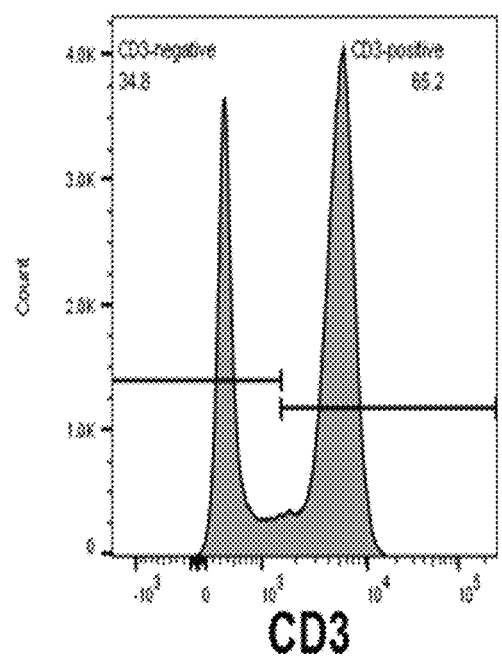
Figure 56C:
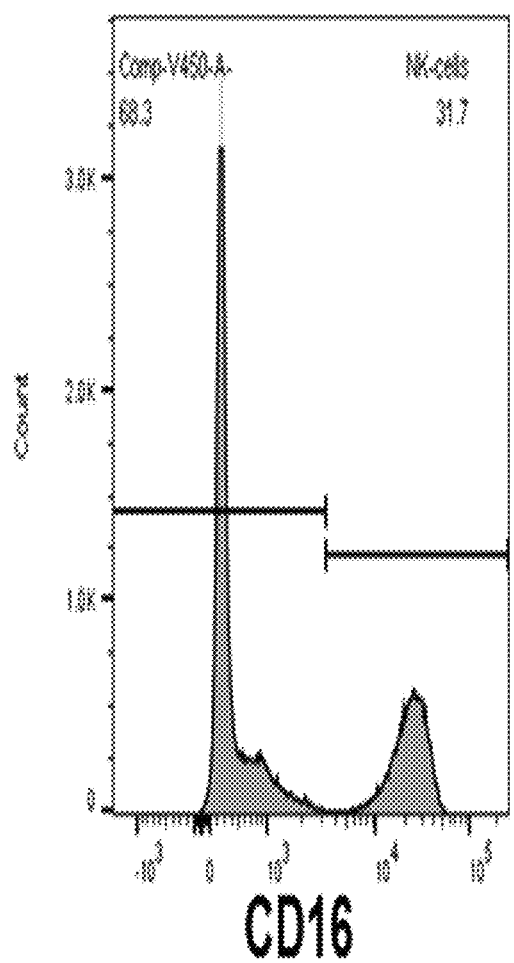
Figure 57A:
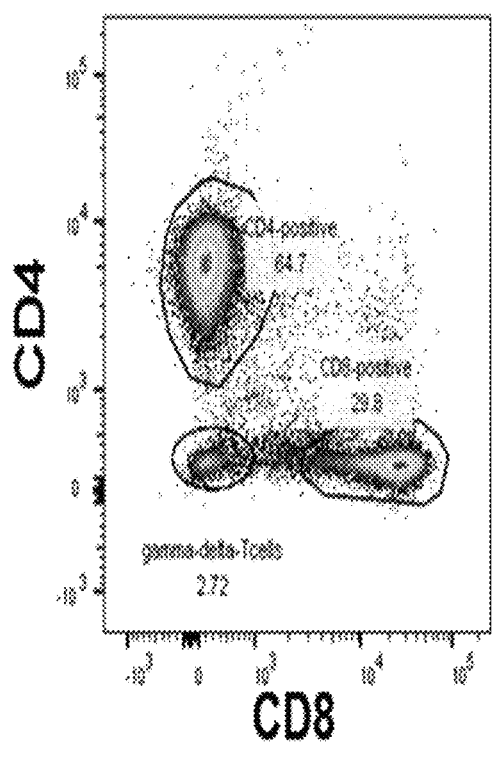
Figure 57B:
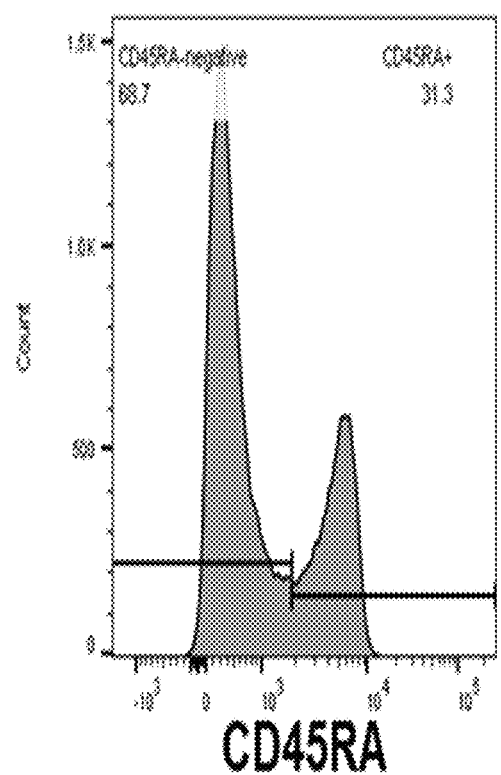
Figure 57C:
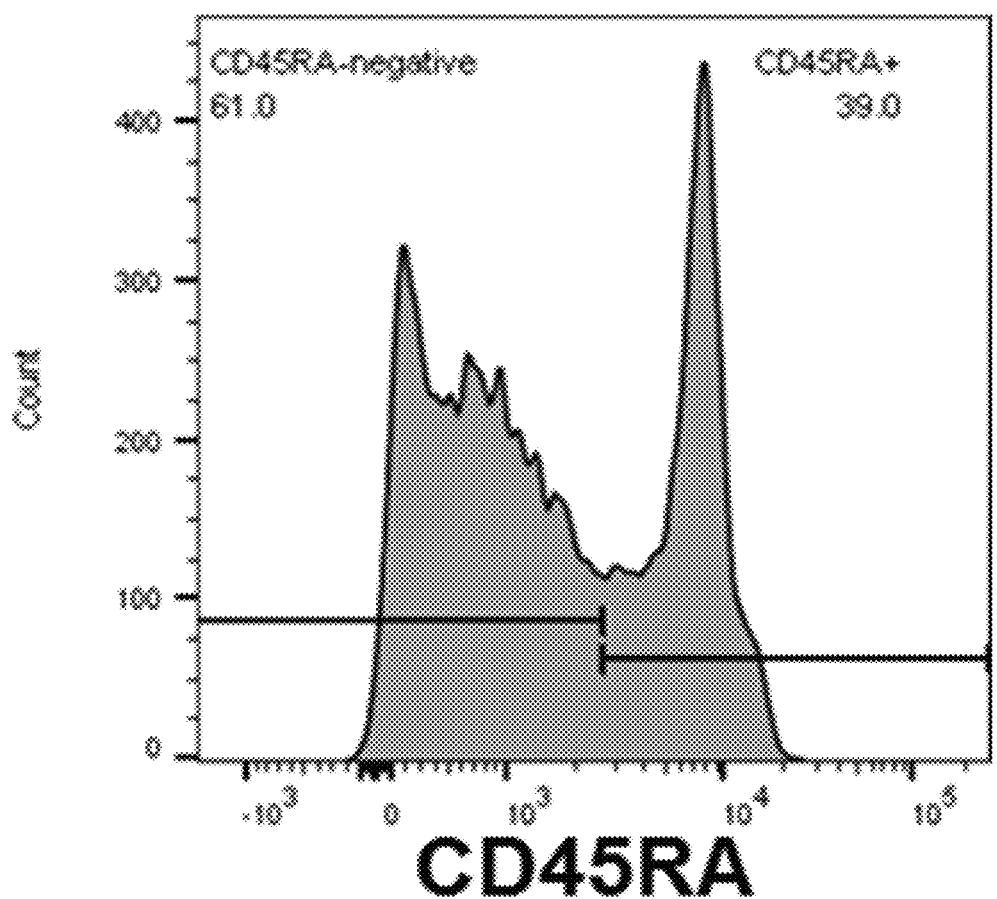
Figure 58A:
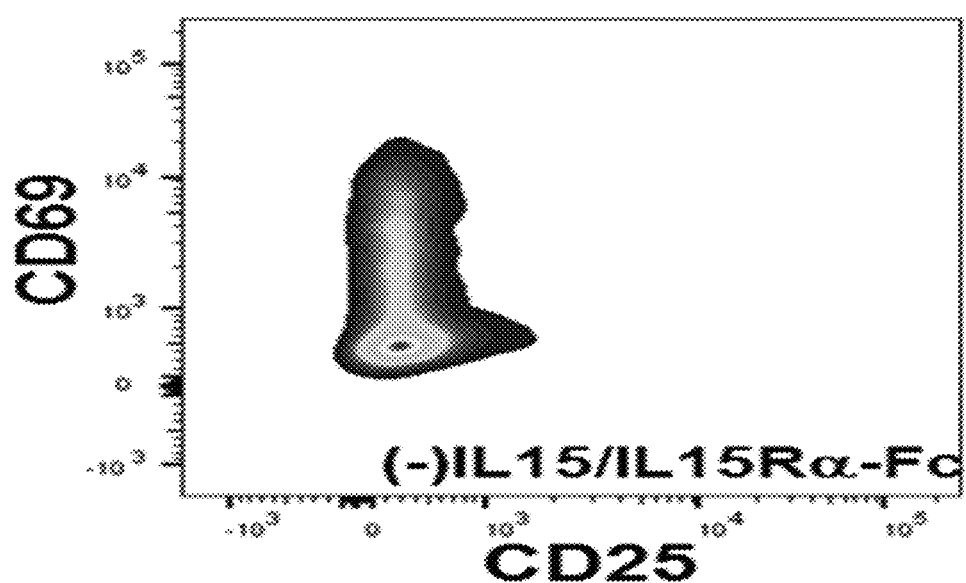
Figure 58B:
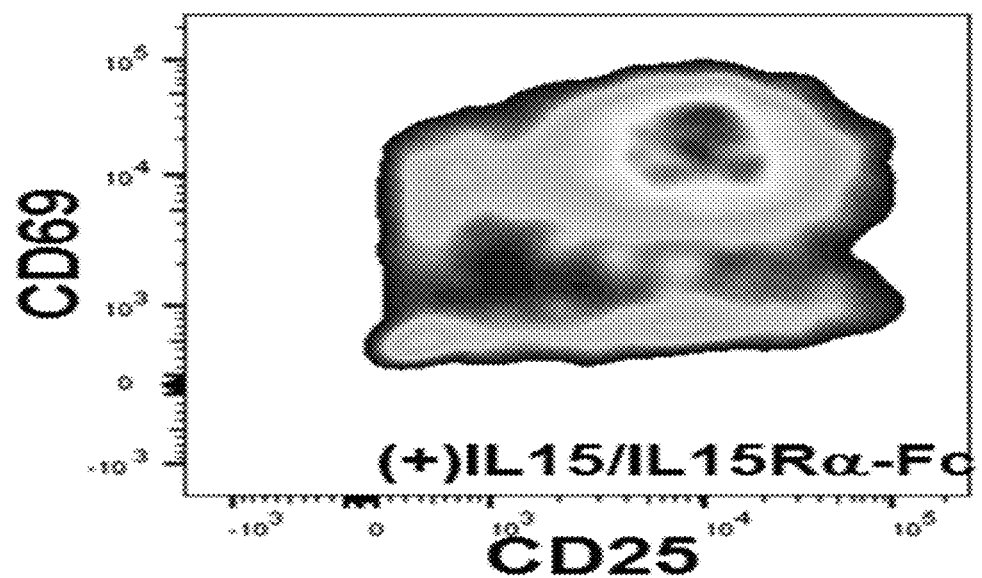
Figure 59A:
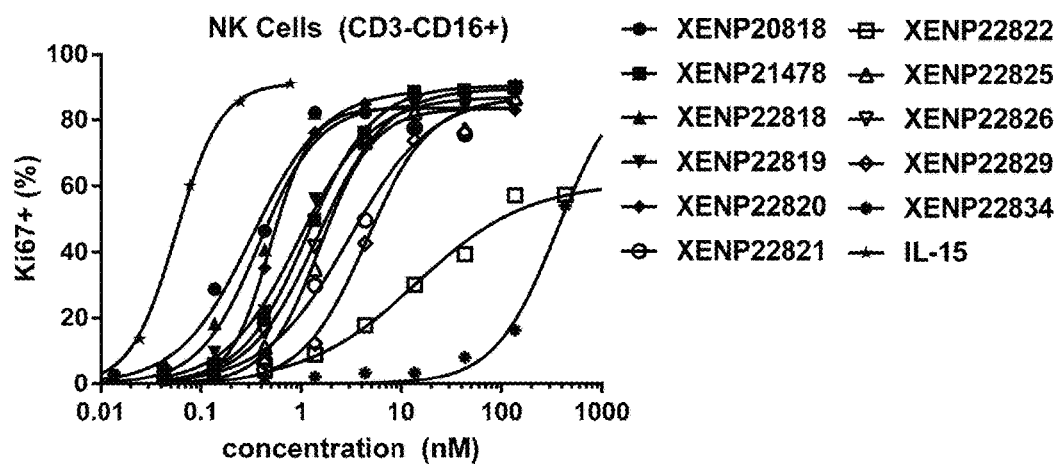
Figure 59B:
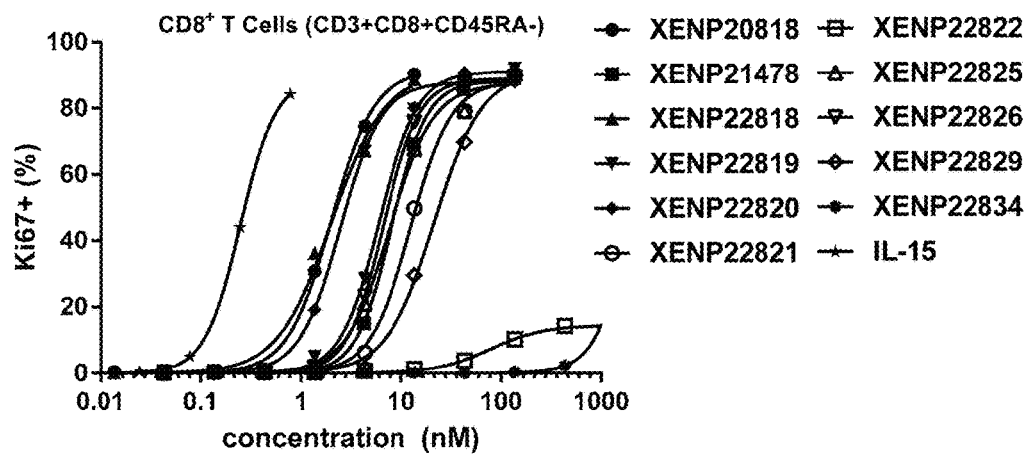
Figure 59C:
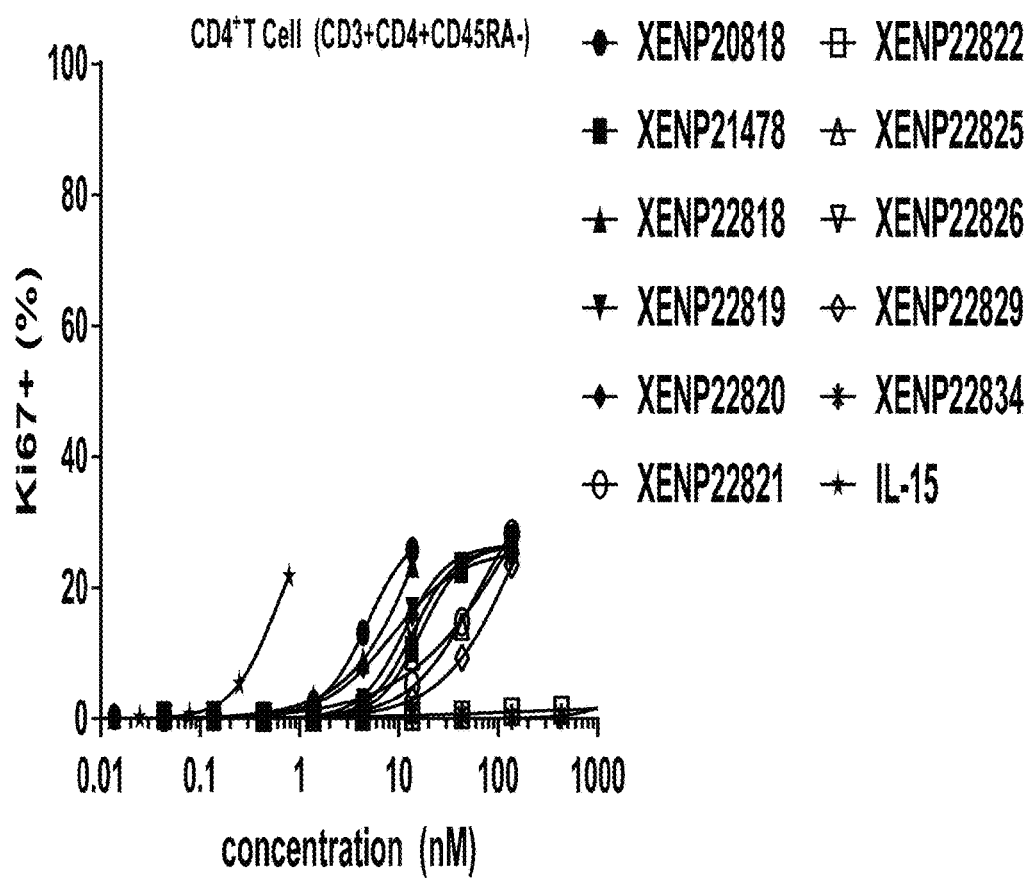
Figure 60A:
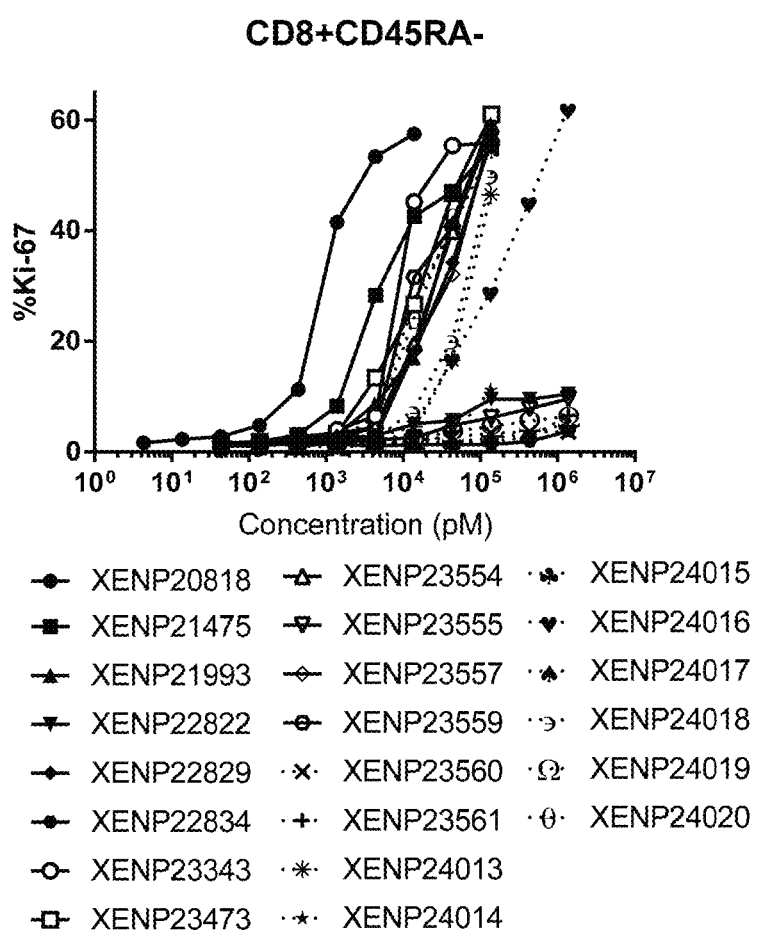
Figure 60B:
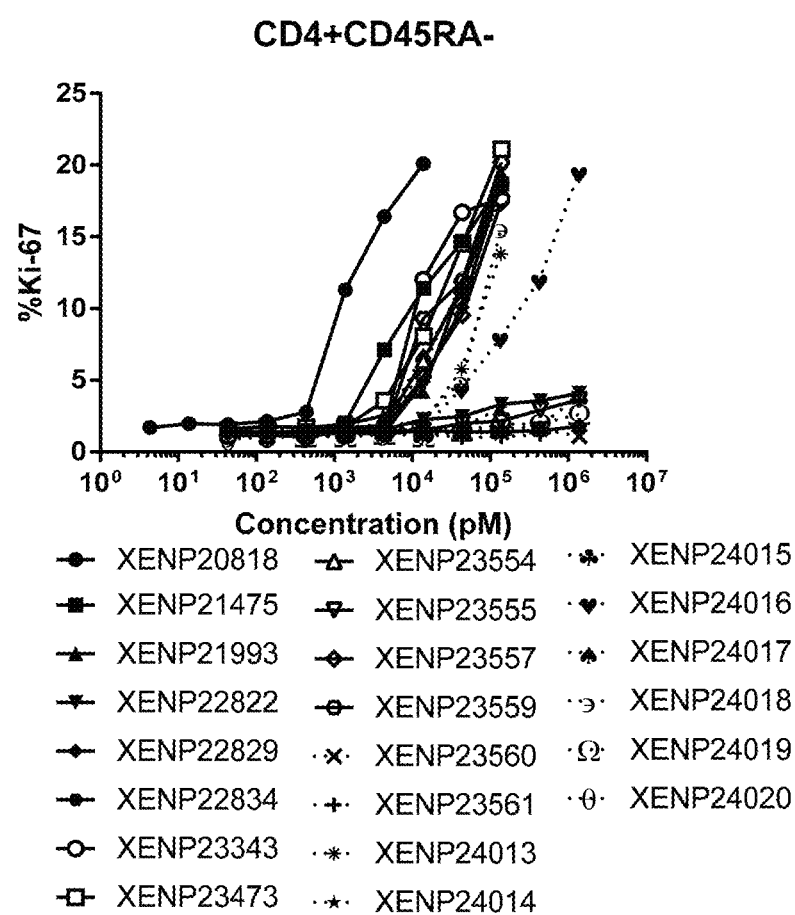
Figure 60C:
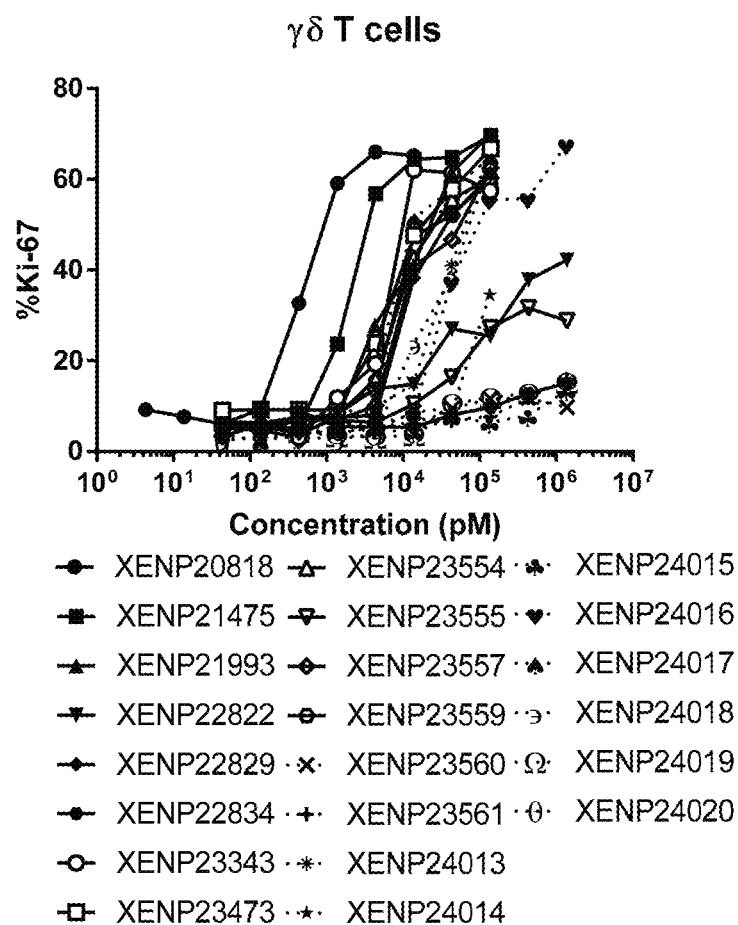
Figure 60D:
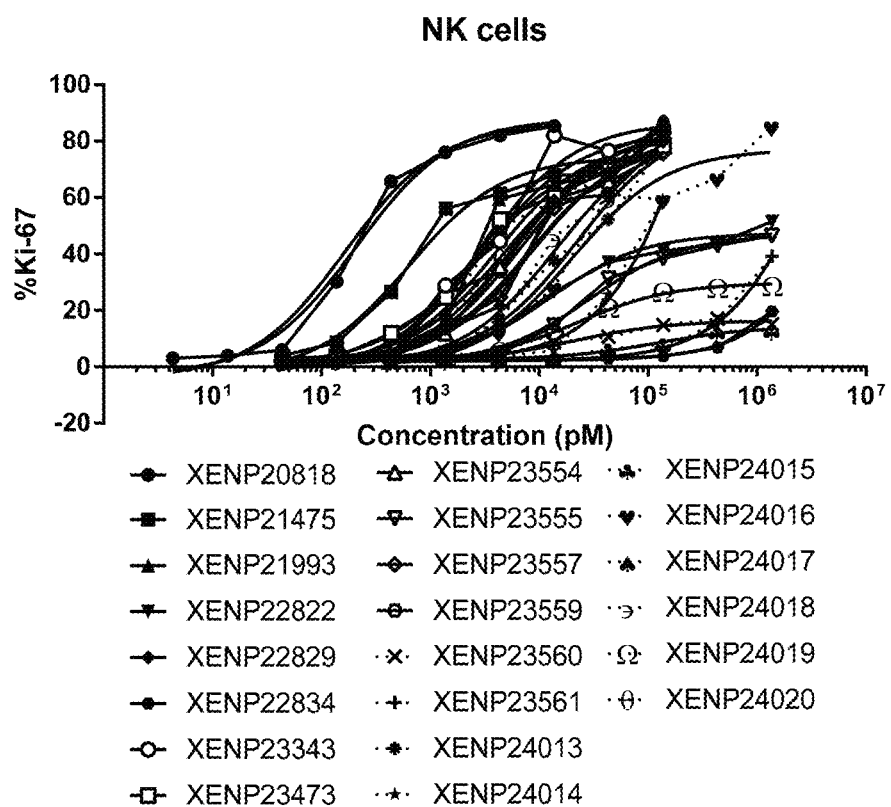

In a second cell proliferation assay, IL-15/Rα-Fc fusion proteins (with or without engineered substitutions) were incubated with PBMCs for 3 days. Following incubation, PBMCs were stained with anti-CD3-FITC (OKT3), anti-CD4-Evolve604 (SK-3), anti-CD8-PerCP/Cy5.5 (RPA-T8), anti-CD16-eFluor450 (CB16), anti-CD56-eFluor450 (TULY56), anti-CD27-PE (O323), anti-CD45RA-APC/Cy7 (HI100) and anti-Ki67-APC (20Raj1) antibodies to mark various cell populations. FIGS. 56-57 depict selection of various cell populations following incubation with XENP22821 by FACS. Lymphocytes were first gated on the basis of side scatter (SSC) and forward scatter (FSC) (FIG. 56A). Lymphocytes were then gated based on CD3 expression (FIG. 56B). Cells negative for CD3 expression were further gated based on CD16 expression to identify NK cells (CD16+) (FIG. 56C). CD3+ T cells were further gated based on CD4 and CD8 expression to identify CD4+ T cells, CD8+ T cells, and γδ T cells (CD3+CD4−CD8−) (FIG. 57A). The CD4+ and CD8+ T cells were gated for CD45RA expression as shown respectively in FIGS. 57B-C. Finally, the proliferation of the various cell populations were determined based on percentage Ki67 expression, and the data are shown in FIGS. 59A-D. NK and CD8+ T cells are more sensitive than CD4+ T cells to IL-15/Rα-Fc fusion proteins, and as above, proliferative activity varied depending on the particular engineered substitutions. FIG. 59D shows the fold change in EC50 of various IL-15/Rα-Fc fusion proteins relative to control XENP20818. FIGS. 58A and B further depict the activation of lymphocytes following treatment with IL-15/Rα-Fc fusion proteins by gating for the expression of CD69 and CD25 (T cell activation markers) before and after incubation of PBMCs with XENP22821.

In a third experiment, additional variant IL-15/Rα-Fc fusion proteins were incubated with human PBMCs for 3 days at 37° C. Following incubation, PBMCs were stained with anti-CD3-FITC (OKT3), anti-CD4-SB600 (SK-3), anti-CD8-PerCP/Cy5.5 (RPA-T8), anti-CD45RA-APC/Cy7 (HI100), anti-CD16-eFluor450 (CB16), anti-CD25-PE (M-A251), and anti-Ki67-APC (Ki-67) to mark various cell populations and analyzed by FACS as generally described in Example 1D. Proliferation of CD8+ (CD45RA−) T cells, CD4+ (CD45RA−) T cells, γδ T cells, and NK cells as indicated by Ki67 expression are depicted in FIGS. 60A-D.

Figure 61A:
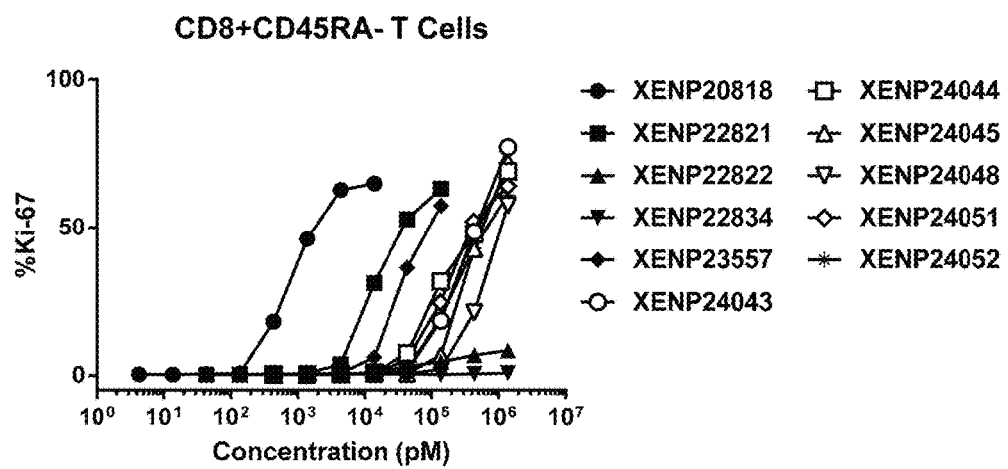
Figure 61B:
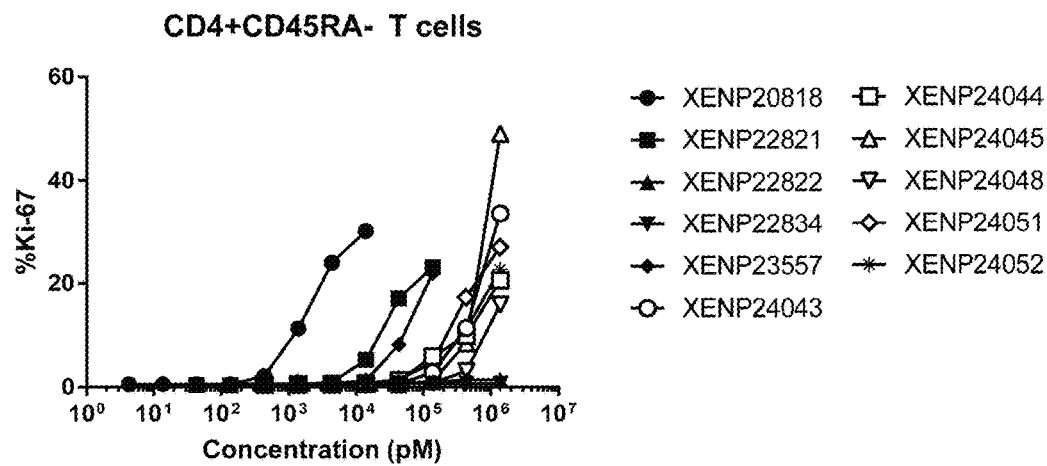
Figure 61C:
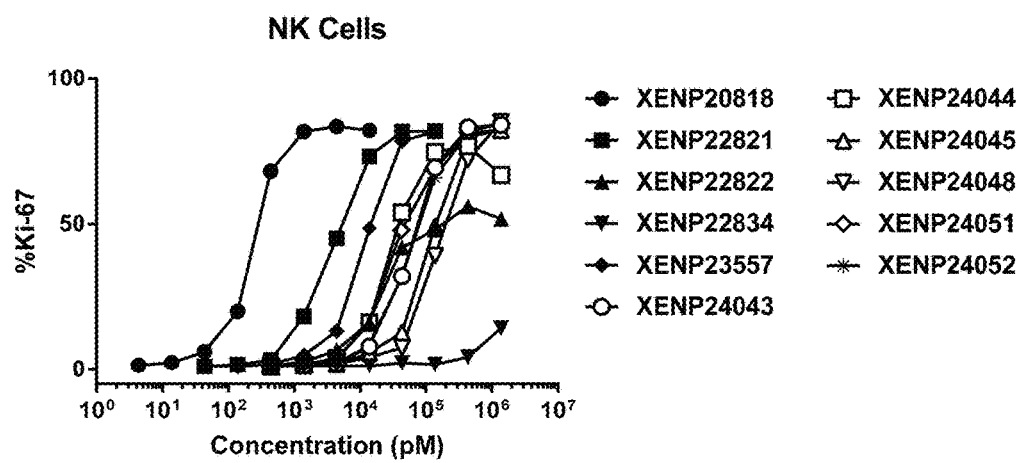
Figure 62A:
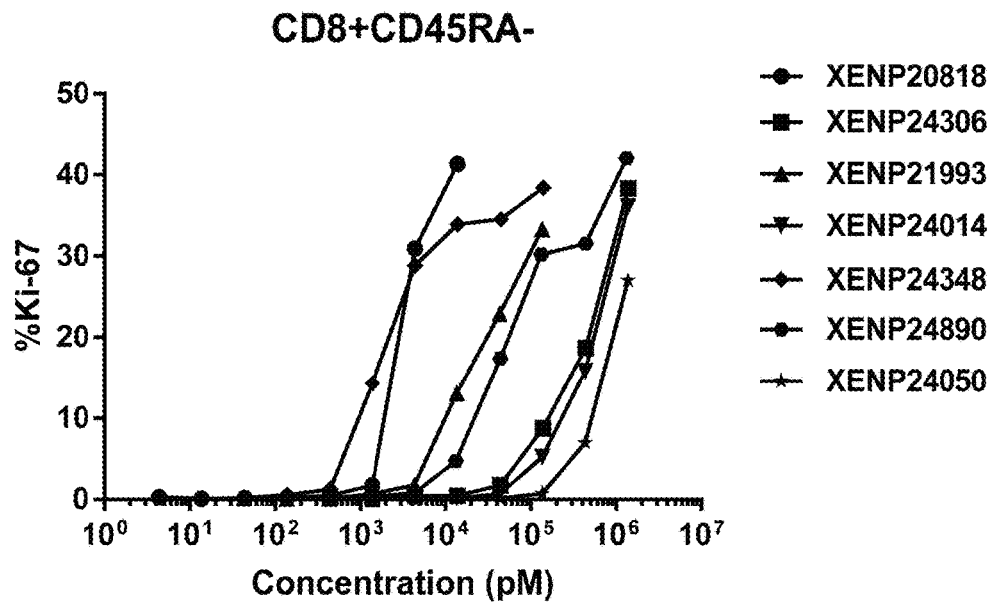
Figure 62B:
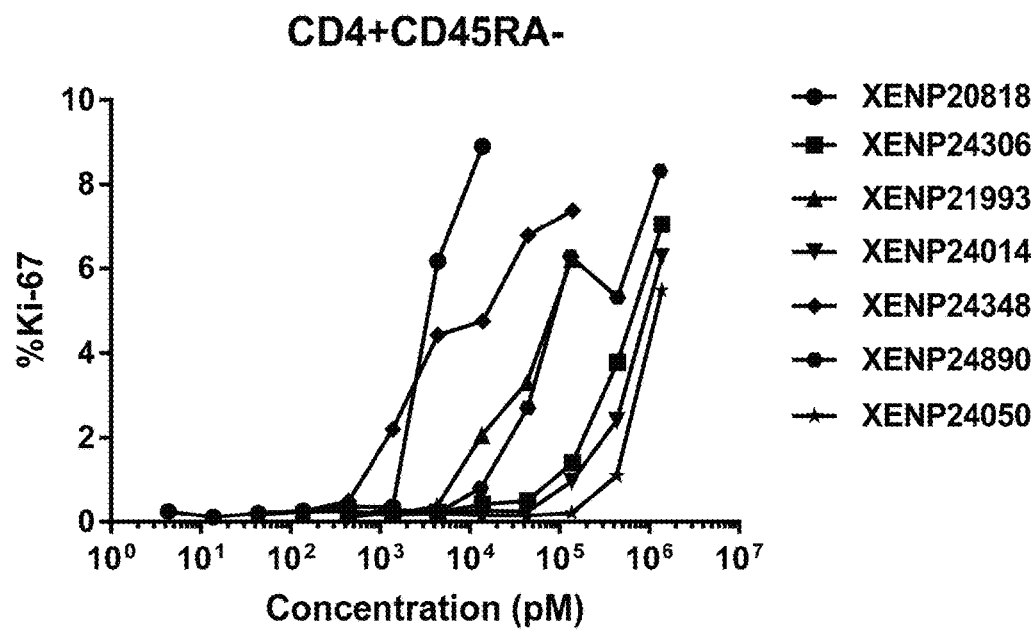
Figure 62C:
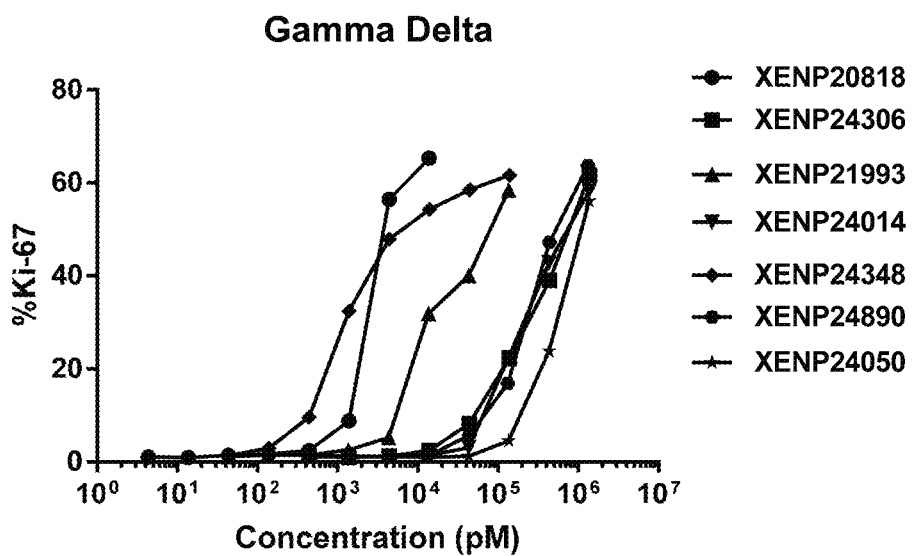
Figure 62D:
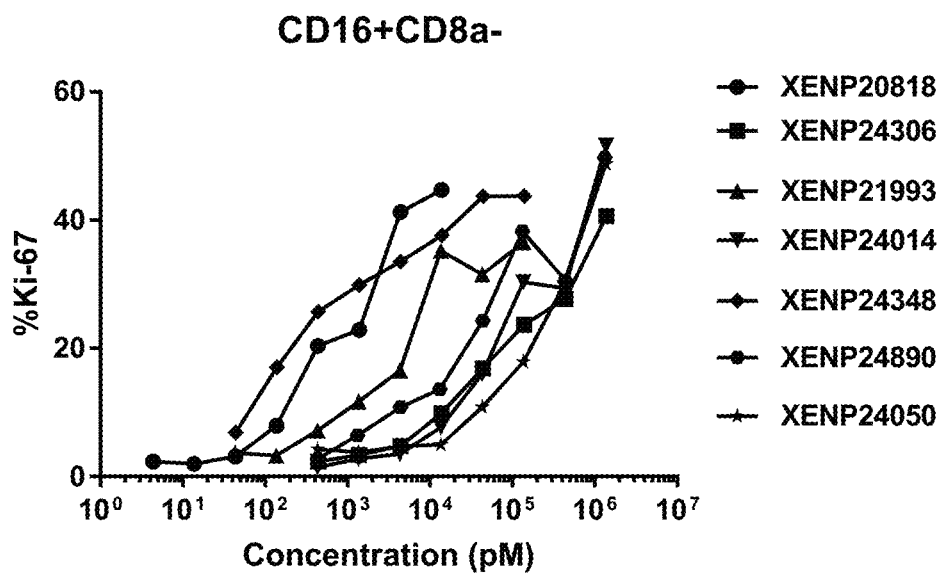
Figure 62E:
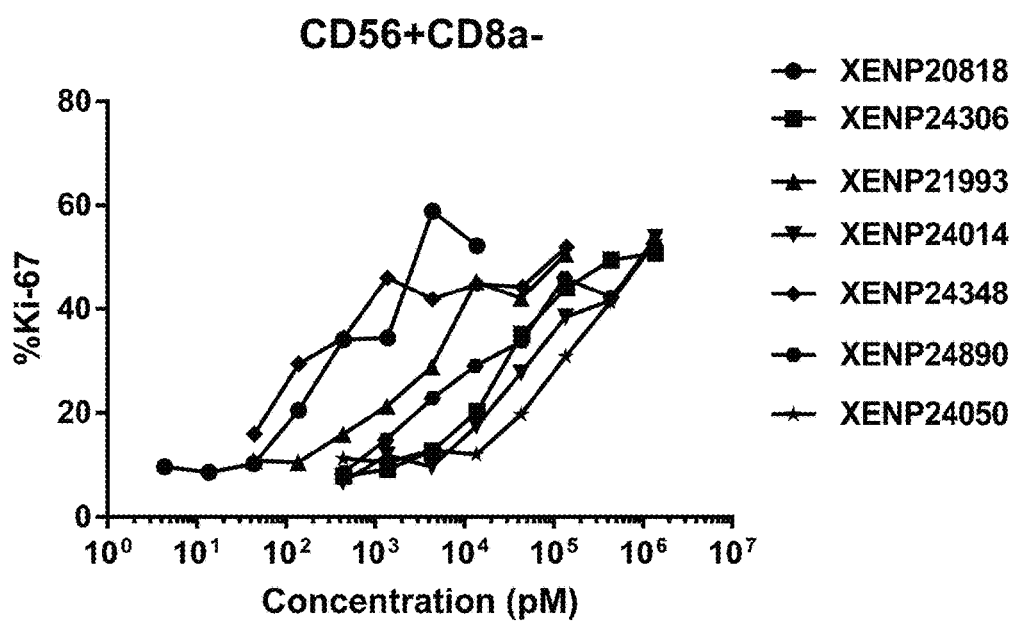
Figure 63A:
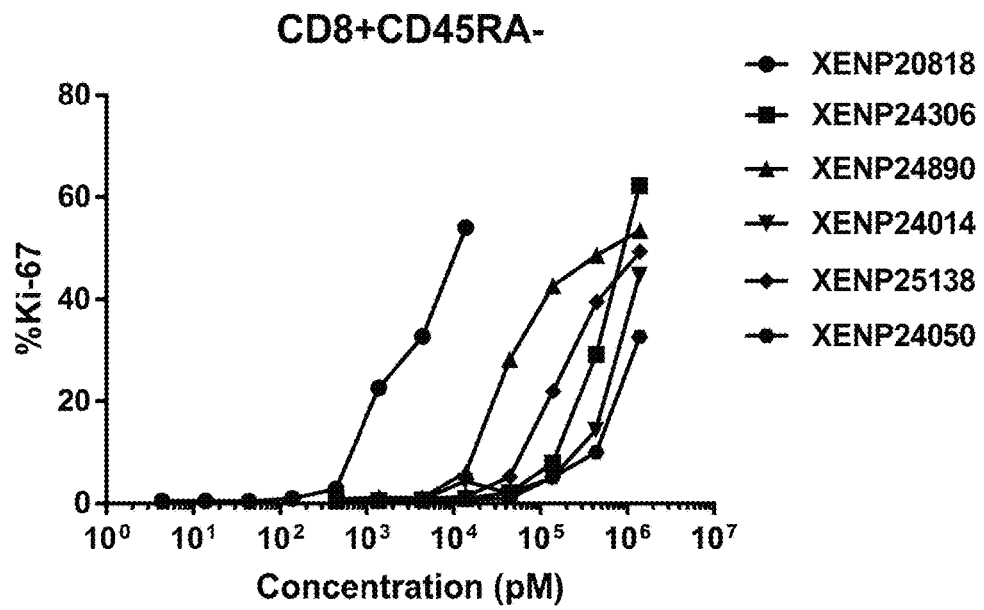
Figure 63B:
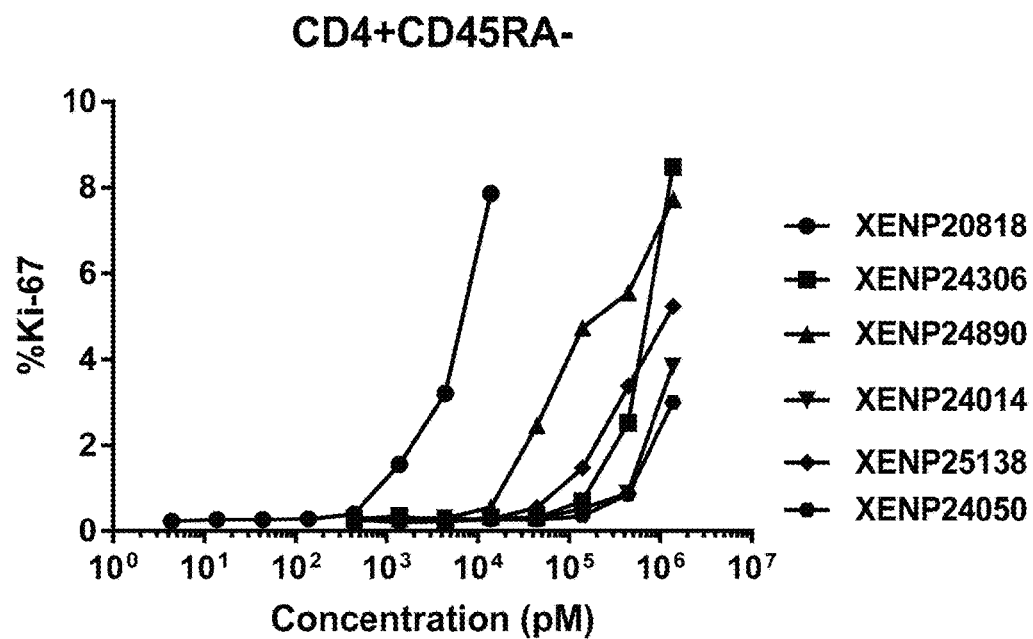
Figure 63C:
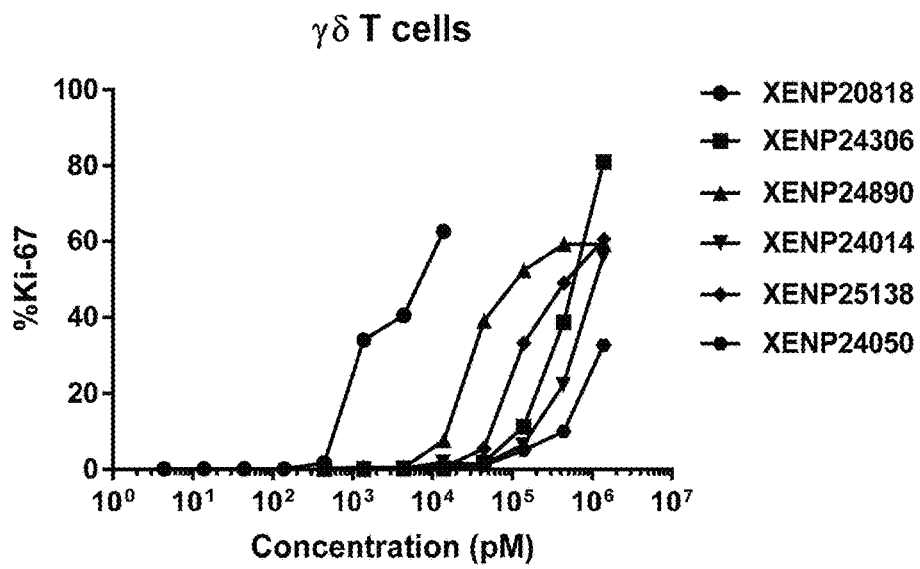
Figure 63D:
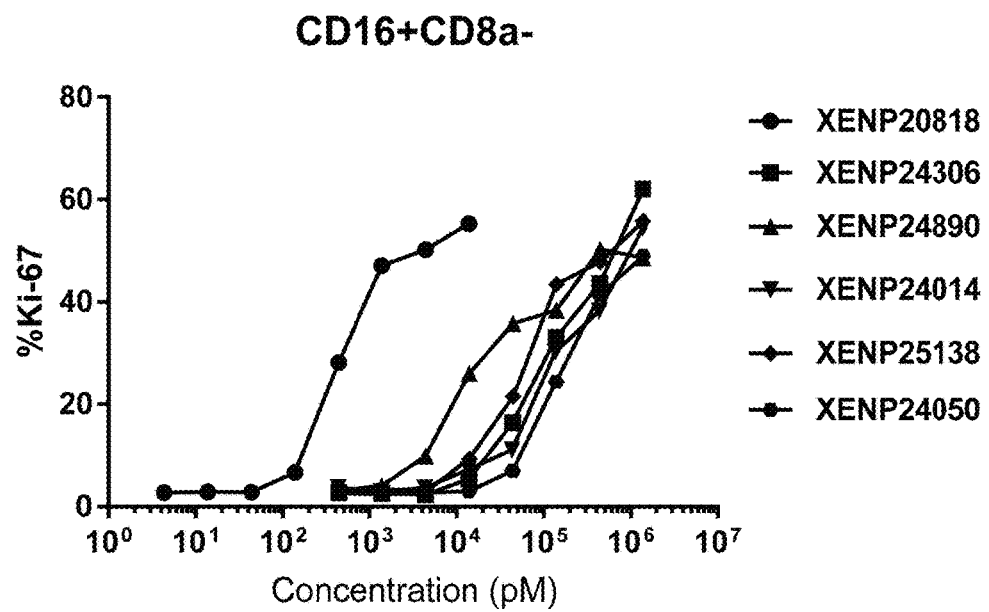
Figure 63E:
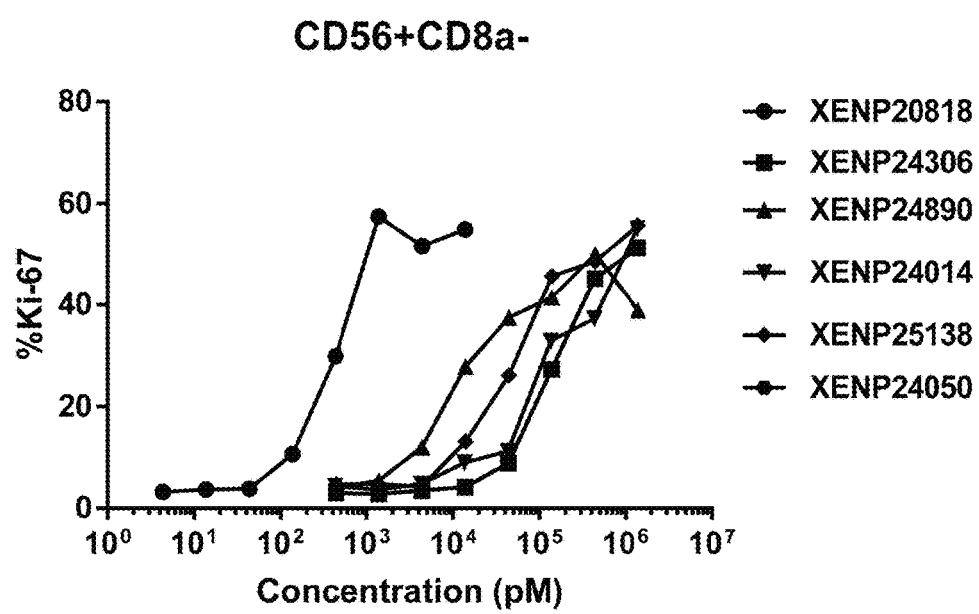
Figure 64A:
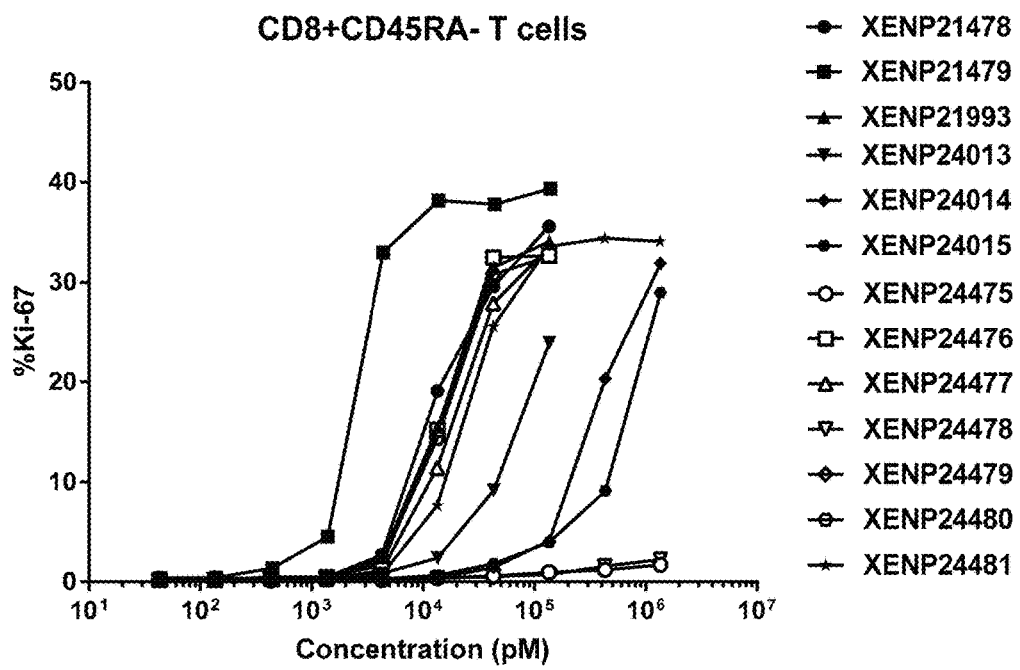
Figure 64B:
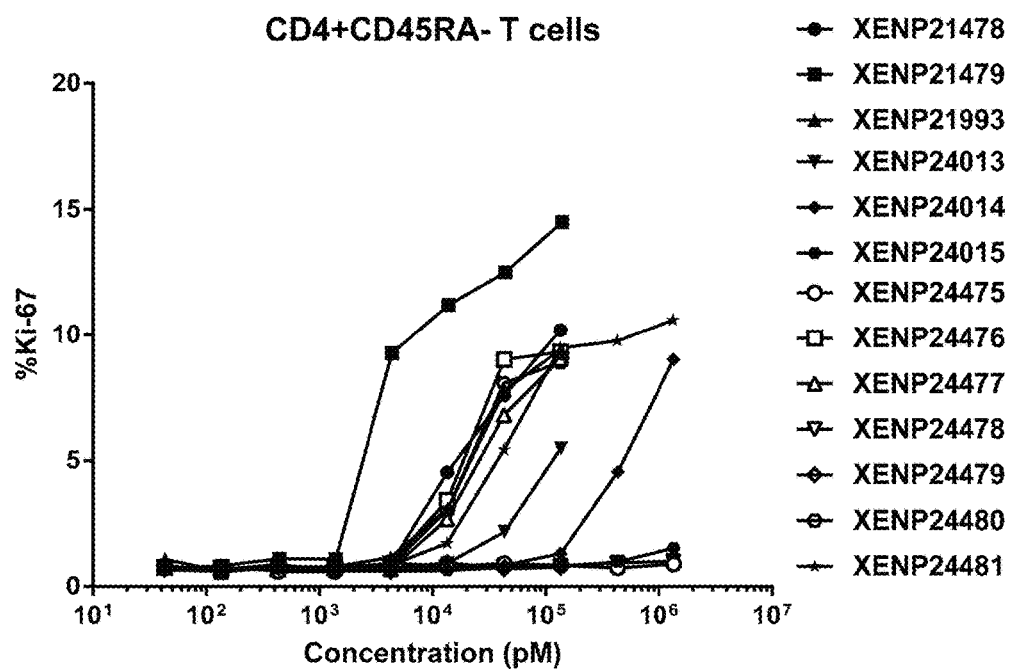
Figure 64C:
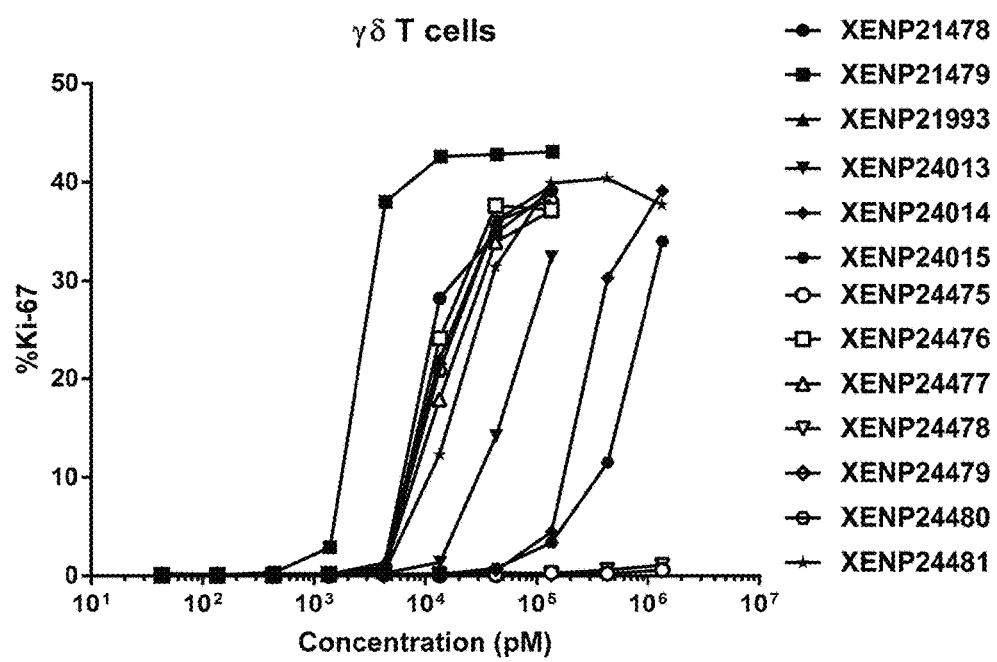
Figure 64D:
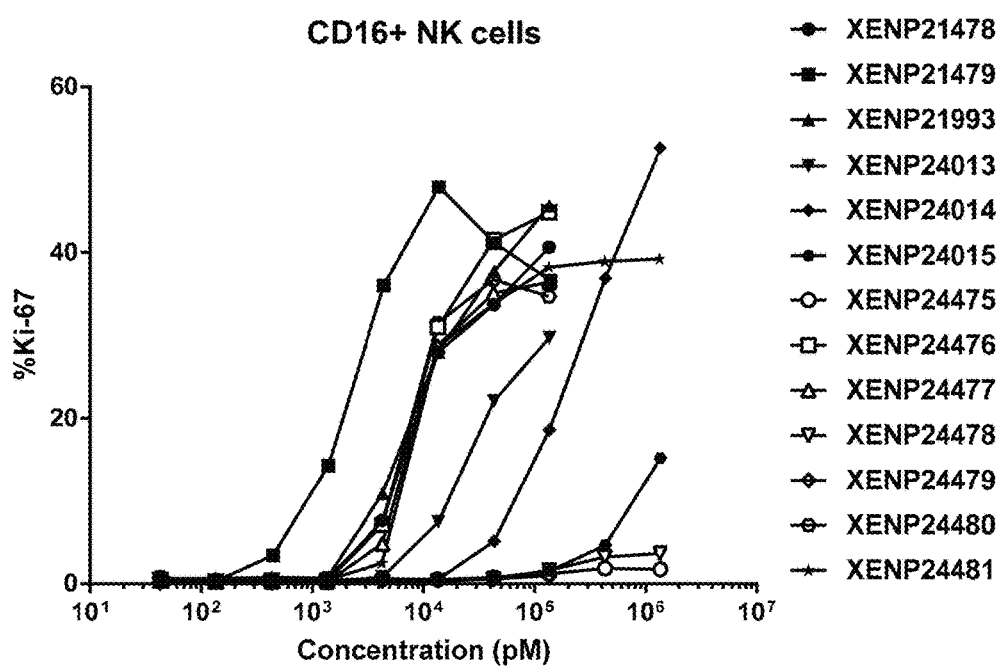
Figure 65A:
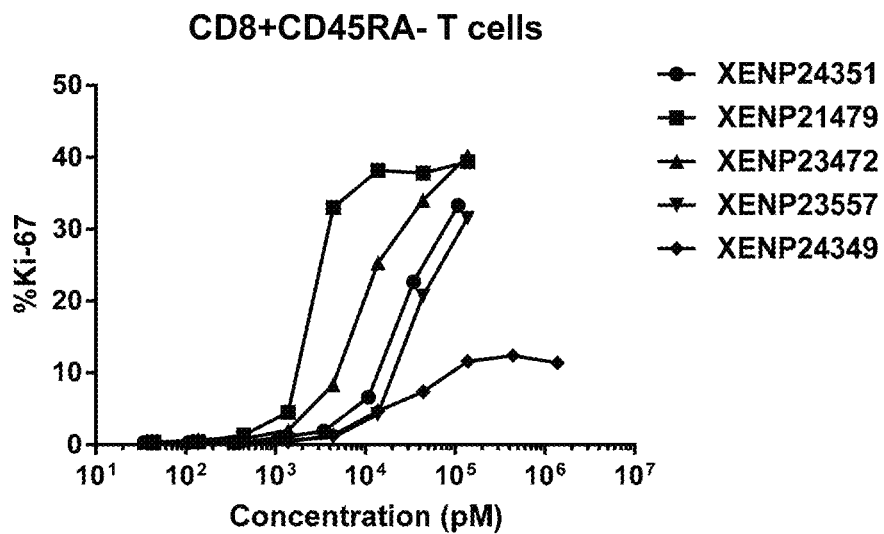
Figure 65B:
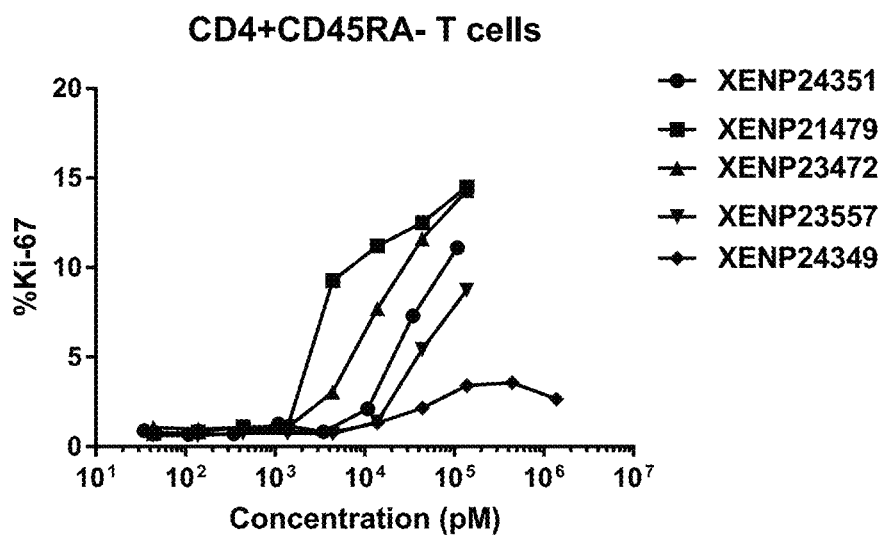
Figure 65C:
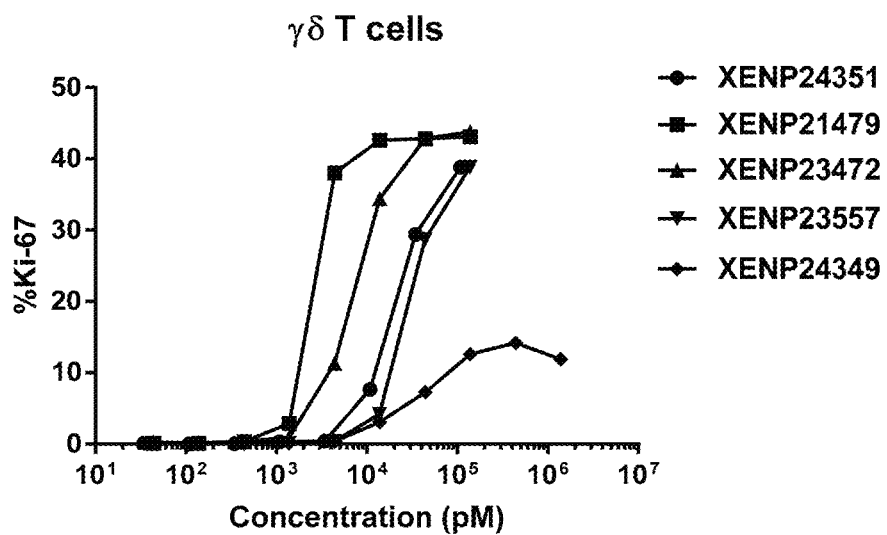
Figure 65D:
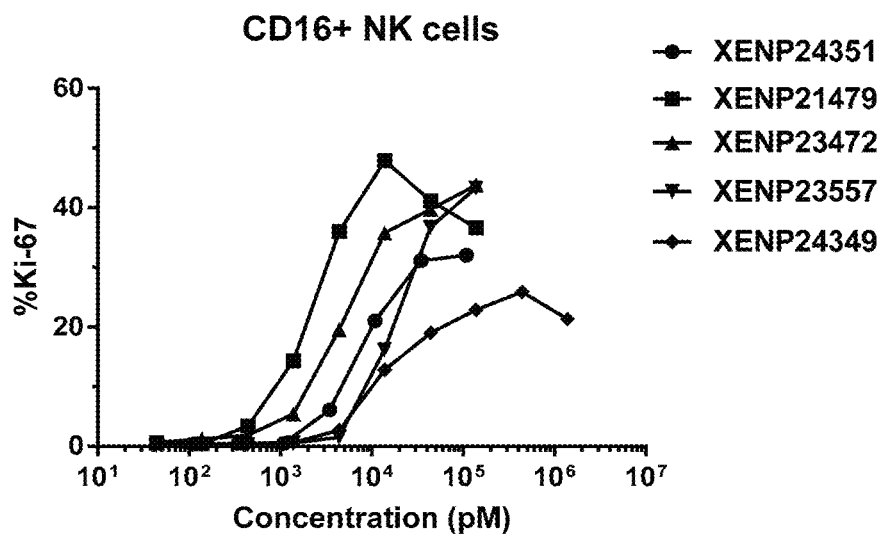

In a fourth experiment, human PBMCs were incubated with the additional IL-15/Rα-Fc variants at the indicated concentrations for 3 days. Following incubation, PBMCs were stained with anti-CD3-FITC (OKT3), anti-CD4 (SB600), anti-CD8-PerCP/Cy5.5 (RPA-T8), anti-CD16-eFluor450 (CB16), anti-CD25-PE (M-A251), anti-CD45RA-APC/Cy7 (HI100), and anti-Ki67-APC (Ki67) and analyzed by FACS as generally described in Example 1D. Percentage of Ki67 on CD8+ T cells, CD4+ T cells and NK cells following treatment are depicted in FIG. 61.

In a fifth experiment, variant IL-15/Rα-Fc fusion proteins were incubated with human PBMCs for 3 days at 37° C. Following incubation, cells were stained with anti-CD3-PE (OKT3), anti-CD4-FITC (RPA-T4), anti-CD8α-BV510 (SK1), anti-CD8ß-APC (2ST8.5H7), anti-CD16-BV421 (3G8), anti-CD25-PerCP/Cy5.5 (M-A251), anti-CD45RA-APC/Cy7 (HI100), anti-CD56-BV605 (NCAM16.2), and anti-Ki67-PE/Cy7 (Ki-67) and analyzed by FACS as generally described in Example 1D. Percentage of Ki67 on CD8+ T cells, CD4+ T cells, γδ T cells, and NK cells are depicted in FIGS. 62A-E.

In a sixth experiment, variant IL-15/Rα-Fc fusion proteins were incubated with human PBMCs for 3 days at 37° C. Following incubation, cells were stained with anti-CD3-PE (OKT3), anti-CD4-FITC (RPA-T4), anti-CD8α-BV510 (SK1), anti-CD8ß-APC (SIDI8BEE), anti-CD16-BV421 (3G8), anti-CD25-PerCP/Cy5.5 (M-A251), anti-CD45RA-APC/Cy7 (HI100), anti-CD56-BV605 (NCAM16.2), and anti-Ki67-PE/Cy7 (Ki-67) and analyzed by FACS as generally described in Example 1D. Percentage of Ki67 on CD8+ T cells, CD4+ T cells, γδ T cells, and NK cells are depicted in FIGS. 63A-E.

C. Example 3C: In Vitro Activity of Variant scIL-15/Rα-Fc Fusion Proteins Engineered for Decreased Potency with Different Linker Lengths Between IL-15 and IL-15Rα

IL-15/Rα-Fc fusion proteins with some of the substitutions described above, further with different lengths linkers between IL-15 and IL-15Rα (as depicted in Table 3) were incubated with human PBMCs at the indicated concentrations for 3 days at 37° C. Following incubation, PBMCs were stained with anti-CD3-PE (OKT3), anti-CD4-FITC (RPA-T4), anti-CD8-APC (RPA-T8), anti-CD16-BV605 (3G8), anti-CD25-PerCP/Cy5.5 (M-A251), anti-CD45RA-APC/Fire750 (HI100) and anti-Ki67-PE/Cy7 (Ki-67) and analyzed by FACS as generally described in Example 1D. Percentage Ki67 on CD8+ T cells, CD4+ T cells, γδ T cells and NK (CD16+) cells are depicted in FIGS. 64A-D. The data show that the ncIL-15/Rα-Fc fusion protein XENP21479 is the most potent inducer of CD8+ T cell, CD4+ T cell, NK (CD16+) cell, and γδ T cell proliferation. Each of the scIL-15/Rα-Fc fusion proteins were less potent than XENP21479 in inducing proliferation, but differences were dependent on both the linker length, as well as the particular engineered substitutions.

TABLE 3

| XENP | Format | Linker between IL-15 and IL-15Rα | Mutation |
|---|---|---|---|
| 24013 | scIL-15/Rα-Fc | (GGGGS)₅ (SEQ ID NO: 18) | D61N |
| 21014 | scIL-15/Rα-Fc | (GGGGS)₅ (SEQ ID NO: 18) | N65D |
| 24015 | scIL-15/Rα-Fc | (GGGGS)₅ (SEQ ID NO: 18) | Q108E |
| 24475 | scIL-15/Rα-Fc | (GGGGS)₆ (SEQ ID NO: 19) | Q108E |
| 24476 | scIL-15/Rα-Fc | (GGGGS)₆ (SEQ ID NO: 19) | N4D/N65D |
| 24478 | scIL-15/Rα-Fc | (GGGGS)₇ (SEQ ID NO: 20) | Q108E |
| 24479 | scIL-15/Rα-Fc | (GGGGS)₇ (SEQ ID NO: 20) | N4D/N65D |
| 24481 | scIL-15/Rα-Fc | 30AA-linker | Q108E |

D. Example 3D: In Vitro Activity of Variant IL-15/Rα-Fc Fusion Proteins Engineered for Decreased Potency in Additional Formats Variant IL-15/Rα-Fc fusion proteins in different formats (as depicted in Table 4) were incubated with human PBMCs at the indicated concentrations for 3 days at 37° C. Following incubation, PBMCs were stained with anti-CD3-PE (OKT3), anti-CD4-FITC (RPA-T4), anti-CD8-APC (RPA-T8), anti-CD16-BV605 (3G8), anti-CD25-PerCP/Cy5.5 (M-A251), anti-CD45RA-APC/Fire750 (HI100) and anti-Ki67-PE/Cy7 (Ki-67) and analyzed by FACS as generally described in Example 1D. Percentage Ki67 on CD8+ T cells, CD4+ T cells, γδ T cells and NK (CD16+) cells are respectively depicted in FIGS. 65A-D. As above, the data show that the ncIL-15/Rα-Fc fusion protein XENP21479 is the most potent inducer of CD8+ T cell, CD4+ T cell, NK (CD16+) cell, and γδ T cell proliferation. Notably, introduction of Q108E substitution into the ncIL-15/Rα-Fc format (XENP24349) drastically reduces its proliferative activity in comparison to wildtype (XENP21479).

TABLE 4

| XENP | Format | Mutation |
|---|---|---|
| 24351 | Bivalent IL-15/Rα-Fc | N4D/N65D |
| 21479 | ncIL-15/Rα-Fc | WT |
| 23472 | dsIL-15/Rα-Fc | N65D |
| 23557 | IL-15/Rα-heteroFc | N4D/N65D |
| 24349 | ncIL-15/Rα-Fc | Q108E |

E. Example 3E: STAT5 Phosphorylation by Variant IL-15/Rα-Fc Fusion Proteins

Transpresentation of IL-15 and IL-15Rα drives phosphorylation of STAT5 and subsequent proliferation of NK and T cells (CD4+ and CD8+). Accordingly, CD8+ and CD4+ T cells were analyzed for STAT5 phosphorylation following 15 minutes incubation with the indicated IL-15/Rα-Fc test articles. PBMCs were stained with anti-CD4-BV421 (RPA-T4) and anti-CD8-A700 (SK1) for 30-45 minutes at room temperature. Cells were washed and incubated with pre-chilled (−20° C.) 90% methanol for 20-60 minutes. After incubation with methanol, cells were washed again and stained with anti-CD45RA-BV510 (HI100), anti-CD27-BV605 (L128), anti-CD25-PE (M-A251), anti-pSTAT5-Alexa647 (pY687), and anti-FoxP3-Alexa488 (259D) to mark various cell populations and STAT5 phosphorylation. FIGS. 66A-D depict selection of various cell populations following incubation with XENP22821. Lymphocytes were first gated on the basis of SSC and FSC (FIG. 66A). The lymphocytes were then gated based on CD4 and CD8 expression to identify CD4+ and CD8+ T cells (FIG. 66B). The CD4+ and CD8+ T cells were then further gated based on CD45RA and CD27 expression to identify further subpopulations depicted respectively in FIGS. 66C-D. Finally, the phosphorylation of STAT5 in the various cell populations was determined, and the data are shown in FIGS. 67A-C. STAT5 phosphorylation on T cells was induced in a dose dependent manner and also varied depending on the particular engineered substitutions. FIG. 67C shows the fold change in EC50 for STAT5 phosphorylation of the variant IL-15/Rα-Fc fusion proteins relative to control.

F. Example 3F: PK of Variant IL-15/Rα-Fc Fusion Proteins Engineered for Lower Potency In order to investigate if IL-15/Rα-Fc fusion proteins engineered for reduced potency had improved half-life and PK, we examined these variants in a PK study in C57BL/6 mice. Two cohorts of mice (5 mice per test article per cohort) were dosed with 0.1 mg/kg of the indicated test articles via IV-TV on Day 0. Serum was collected 60 minutes after dosing and then on Days 2, 4, and 7 for Cohort 1 and Days 1, 3, and 8 for Cohort 2. Serum levels of IL-15/Rα-Fc fusion proteins were determined using anti-IL-15 and anti-IL-15Rα antibodies in a sandwich ELISA. The results are depicted in FIG. 68. FIG. 69 depicts the correlation between potency and half-life of the test articles.

As predicted, variants with reduced potency demonstrated substantially longer half-life. Notably, half-life was improved up to almost 9 days (see XENP22821 and XENP22822), as compared to 0.5 days for the wild-type control XENP20818.

G. Example 3G: Variant IL-15/Rα-Fc Fusion Proteins Enhance Engraftment and Disease Activity in Human PBMC-Engrafted NSG Mice The variant IL-15/Rα-Fc fusion proteins were evaluated in a GVHD models conducted in female NSG immunodeficient mice as generally described in Example 1F.

In a first study, 10 million human PBMCs were engrafted into NSG mice via IV-OSP on Day 0 followed by dosing of IL-15/Rα-Fc fusion proteins at the indicated concentrations on Day 1. CD45+ proliferation correlates with decreased body weight (as shown in FIG. 70), and so CD45+ cells were measured on Days 4 and 8 as an indicator of disease activity in this study (FIG. 71A-B). The data show that each of the IL-15/Rα-Fc fusion proteins enhance proliferation of CD45+ cells in human PBMC-engrafted NSG mice as compared to control (PBS).

In another study, 10 million human PBMCs were engrafted into NSG mice via IV-OSP on Day 0 followed by dosing with IL-15/Rα-Fc fusion proteins at the indicated concentrations on Day 1. IFNγ levels and human NK cell, CD45+ lymphocytes, CD8+ T cell and CD4+ T cell counts were measured at days 4, 7, and 11 (FIGS. 72-76). The data show that the variant IL-15/Rα-Fc fusion proteins enhance IFNγ secretion and proliferation of human NK cell and T cells in a dose dependent manner. Notably, the observed activity is correlated to the in vitro potency of each variant.

In yet another study, 10 million human PBMCs were engrafted into NSG mice via IV-OSP on Day −8 followed by dosing with the indicated test articles at the indicated concentrations on Day 0. IFNγ levels and human NK cell, CD45+ lymphocytes, CD8+ T cell and CD4+ T cell counts were measured at Days 4, 7, and 11. FIG. 77 depicts IFNγ levels in mice serum on Days 4, 7, and 11. FIGS. 78A-C respectively depict CD8+ T cell counts on Days 4, 7, and 11. FIGS. 79A-C respectively depict CD4+ T cell counts on Days 4, 7, and 11. FIGS. 80A-C respectively depict CD45+ cell counts on Days 4, 7, and 11. Body weight of the mice were also measured on Days 4, 7, and 11 and depicted as percentage of initial body weight in FIG. 81.

H. Example 3H: IL-15/Rα-Fc Fusion Proteins are Active in Cynomolgus Monkeys

Cynomolgus monkeys were administered a single intravenous (i.v.) dose of XENP20818 (n=3), XENP22819 (n=1), XENP22821 (n=3), XENP22822 (n=3), XENP22834 (n=3), and XENP23343 (n=3). Lymphocyte counts (FIGS. 82, 84, 86, 88, 90, and 92) and proliferation (FIGS. 83, 85, 87, 89, 91, and 93) were assessed over time. The data show significant changes in CD56+ NK cells (FIG. 86A), CD16+ NK cells (FIG. 86B), γδ T cells (FIG. 86C), CD8+ T cells (CD45RA+) (FIG. 86D), CD8+ T cells (CD45RA−) (FIG. 86E), and CD4+ T cells (FIG. 86F) following treatment with XENP22821 peaking at Day 6 with subsequent recovery and normalizing. Finally, the Figures show significant expression of Ki67 on CD56+ NK cells (FIG. 87A), CD16+ NK cells (FIG. 87B), CD8+ T cells (CD45RA+) (FIG. 87C), CD8+ T cells (CD45RA−) (FIG. 87D), and CD4+ T cells (FIG. 87E) indicating proliferative activity following treatment with XENP22821. Similar proliferative activity was observed following treatment with XENP20818, XENP22819, XENP22822, and XENP23343, demonstrating that most of the IL-15/Rα-Fc fusion proteins of the invention are active in cynomolgus monkeys.

XIII. Example 4: IL-15/Rα-Fc Fusion Proteins Engineered with Xtend Fe

IL-15/Rα-Fc variants engineered for decreased potency as described above were further engineered with Xtend Fc (hereon referred to as "IL-15/Rα-XtendFc" fusion proteins) to further increase half-life by subcloning plasmids coding for IL-15 and/or IL-15Rα(sushi) into a pTT5 expression vector containing Fc fusion partners with M428L/N434S substitutions (see FIG. 8, Backbone 11). Sequences for illustrative IL-15/Rα-XtendFc are depicted in FIGS. 94-96 (see also Table 5).

TABLE 5

| XENP | Format | Mutation |
|---|---|---|
| 24306 | IL-15/Rα-heteroFc | D30N/E64Q/N65D |
| 24341 | IL-15/Rα-heteroFc | N1D/N65D |
| 24301 | IL-15/Rα-heteroFc | N4D/N65D |
| 24383 | ncIL-15/Rα-Fc | Q108E |
| 24346 | Bivalent IL-15/Rα-Fc | Q108E |

A. Example 4A: In Vitro Activity of Additional IL-15/Rα-Fc Variants

Human PBMCs were incubated with the IL-15/Rα-XtendFc variants at the indicated concentrations for 3 days. Following incubation, PBMCs were stained with anti-CD3-FITC (OKT3), anti-CD4-PE (RPA-T4), anti-CD8-eFluor450 (SK-1), anti-CD45RA-PE/Cy7 (HI100), anti-CD16-PerCP/Cy5.5 (3G8), anti-CD25-APC/Fire750 (M-A251), and anti-Ki67-APC (Ki-67) to mark various cell populations and analyzed by FACS as generally described in Example 1D. Proliferation of CD8+ T cells, CD4+ T cells and NK cells following treatment as indicated by Ki67 expression are depicted in FIG. 97.

As the Xtend variants were selected for investigating activity in cynomolgus monkeys, their ability to proliferate cynomolgus T cells was investigated. Cyno PBMCs were incubated with selected test articles at the indicated concentrations for 3 days. Following incubation, PBMCs were stained with anti-CD3-FITC (SP34), anti-CD4-PE/Cy7 (OKT4), anti-CD8-APC (RPA-T8), anti-CD45RA-APC/Fire750 (HI100), anti-CD16-BV605 (3G8), anti-CD25-BV421 (M-A251), and anti-Ki67-PerCP/Cy5.5 (Ki-67) to mark various cell populations and analyzed by FACS as generally described in Example 1D. Proliferation of CD8+ T cells, CD4+ T cells and NK cells following treatment as indicated by Ki67 expression are depicted in FIG. 98.

B. Example 4B: In Vivo Activity of IL-15/Rα-XtendFc Variants in a GVHD Model 10 million human PBMCs were engrafted into NSG mice via IV-OSP on Day −7 followed by dosing with the indicated test articles (0.3 mg/kg) on Day 0. Whole blood was collected on Day 4 and 7, and mice were sacrificed on Days 5-8 or 11 for their spleens to measure CD4+ T cell, CD8+ T cell, and CD45+ cell counts using FACS. FIGS. 99A-C respectively depict CD4+ T cell counts on Days 4 and 7 in whole blood and Day 8 in spleen. FIGS. 100A-C, respectively depict CD8+ T cell counts on Days 4 and 7 in whole blood and Day 8 in spleen. FIGS. 101A-C respectively depict CD4+ T cell counts on Days 4 and 7 in whole blood and Day 8 in spleen. Body weight of the mice were also measured on Day −8, −2, 1, 5, 8 and 11 as depicted in FIGS. 102A-102F. Each point represents one female NSG mouse.

C. Example 4C: In Vivo Activity of Variant IL-15/Rα-XtendFc Fusion Proteins in Cynomolgus Monkeys Monkeys (n=3) were administered a single intravenous (i.v.) dose of indicated test articles (Day 1) and blood was collected daily. CD8+ T cell, CD4+ T cell and NK cell counts in blood were assessed over time as depicted respectively in FIGS. 103A-C. Each point is an average of 3 cynomolgus monkeys. The data show that each of the variants were active in proliferating immune cells indicating that the IL-15/Rα-Fc fusion proteins of the invention could be useful as therapeutics for cancer in humans.

The examples set forth above are provided to give those of ordinary skill in the art a complete disclosure and description of how to make and use the embodiments of the compositions, systems and methods of the invention, and are not intended to limit the scope of what the inventors regard as their invention. Modifications of the above-described modes for carrying out the invention that are obvious to persons of skill in the art are intended to be within the scope of the following claims. All patents and publications mentioned in the specification are indicative of the levels of skill of those skilled in the art to which the invention pertains. All references cited in this disclosure are incorporated by reference to the same extent as if each reference had been incorporated by reference in its entirety individually.

All headings and section designations are used for clarity and reference purposes only and are not to be considered limiting in any way. For example, those of skill in the art will appreciate the usefulness of combining various aspects from different headings and sections as appropriate according to the spirit and scope of the invention described herein.

All references cited herein are hereby incorporated by reference herein in their entireties and for all purposes to the same extent as if each individual publication or patent or patent application was specifically and individually indicated to be incorporated by reference in its entirety for all purposes.

Many modifications and variations of this application can be made without departing from its spirit and scope, as will be apparent to those skilled in the art. The specific embodiments and examples described herein are offered by way of example only, and the application is to be limited only by the terms of the appended claims, along with the full scope of equivalents to which the claims are entitled.

SEQUENCE LISTING (1204 sequences)

SEQ ID NO: 1 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 2 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 3 - protein, 267 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 4 - protein, 65 aa, Homo sapiens
ITCPPPMSVEHADIWVKSYSLYSRERYICNSGFKRKAGTSSLTECVLNKATNVAHWTTPSLKCIR

SEQ ID NO: 5 - protein, 162 aa, Homo sapiens; identical to SEQ ID NO: 1

SEQ ID NO: 6 - protein, 114 aa, Homo sapiens; identical to SEQ ID NO: 2

SEQ ID NO: 7 - protein, 267 aa, Homo sapiens; identical to SEQ ID NO: 3

SEQ ID NO: 8 - protein, 175 aa, Homo sapiens
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 9 - protein, 65 aa, Homo sapiens; identical to SEQ ID NO: 4

SEQ ID NO: 10 - protein, 551 aa, Homo sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 11 - protein, 214 aa, Homo sapiens
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 12 - protein, 369 aa, Homo sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 13 - protein, 240 aa, Homo sapiens
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEA

SEQ ID NO: 14 - protein, 5 aa, Artificial Sequence
  Description of Artificial Sequence: Synthetic peptide
GGGGS

SEQ ID NO: 15 - protein, 10 aa, Artificial Sequence
  Description of Artificial Sequence: Synthetic peptide
GGGGSGGGGS

SEQ ID NO: 16 - protein, 15 aa, Artificial Sequence
  Description of Artificial Sequence: Synthetic peptide
GGGGSGGGGSGGGGS

SEQ ID NO: 17 - protein, 20 aa, Artificial Sequence
  Description of Artificial Sequence: Synthetic peptide
GGGGSGGGGSGGGGSGGGGS

SEQ ID NO: 18 - protein, 25 aa, Artificial Sequence
  Description of Artificial Sequence: Synthetic peptide
GGGGSGGGGSGGGGSGGGGSGGGGS

SEQ ID NO: 19 - protein, 30 aa, Artificial Sequence
  Description of Artificial Sequence: Synthetic polypeptide
GGGGSGGGGSGGGGSGGGGSGGGGSGGGGS

SEQ ID NO: 20 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 21 - protein, 30 aa, Artificial Sequence
  Description of Artificial Sequence: Synthetic polypeptide
DPALVHQRPAPPGGGGSGGGGSGGGGSGGG

SEQ ID NO: 22 - protein, 5 aa, Artificial Sequence
  Description of Artificial Sequence: Synthetic peptide
GKPGS

SEQ ID NO: 23 - protein, 25 aa, Artificial Sequence
  Description of Artificial Sequence: Synthetic peptide
GKPGSGKPGSGKPGSGKPGSGKPGS

SEQ ID NO: 24 - protein, 30 aa, Artificial Sequence
  Description of Artificial Sequence: Synthetic polypeptide
GKPGSGKPGSGKPGSGKPGSGKPGSGKPGS

SEQ ID NO: 25 - protein, 5 aa, Artificial Sequence
  Description of Artificial Sequence: Synthetic peptide
GGGES

SEQ ID NO: 26 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29 - protein, 231 aa, Artificial Sequence; identical to SEQ ID NO: 27
  Description of Artificial Sequence: Synthetic polypeptide
  IL-15/Ralpha-Fc monomer 2

SEQ ID NO: 30 - protein, 231 aa, Artificial Sequence; identical to SEQ ID NO: 28
  Description of Artificial Sequence: Synthetic polypeptide
  IL-15/Ralpha-Fc monomer 1

SEQ ID NO: 31 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 32 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 33 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 34 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 35 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 36 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 37 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 38 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 40 - protein, 229 aa, Artificial Sequence
  Description of Artificial Sequence: Synthetic polypeptide
  IL-15/Ralpha-Fc monomer 1
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 41 - protein, 229 aa, Artificial Sequence
  Description of Artificial Sequence: Synthetic polypeptide
  IL-15/Ralpha-Fc monomer 2
ESKYGPPCPPCPAPEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 42 - protein, 228 aa, Artificial Sequence
  Description of Artificial Sequence: Synthetic polypeptide
  IL-15/Ralpha-Fc monomer 1
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 43 - protein, 228 aa, Artificial Sequence
  Description of Artificial Sequence: Synthetic polypeptide
  IL-15/Ralpha-Fc monomer 2
ERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 44 - protein, 228 aa, Artificial Sequence
  Description of Artificial Sequence: Synthetic polypeptide
  IL-15/Ralpha-Fc monomer 1
ERKCCVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 45 - protein, 228 aa, Artificial Sequence
  Description of Artificial Sequence: Synthetic polypeptide
  IL-15/Ralpha-Fc monomer 2
ERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 46 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 47 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 48 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - protein, 231 aa, Artificial Sequence; identical to SEQ ID NO: 48
  Description of Artificial Sequence: Synthetic polypeptide
  IL-15/Ralpha-Fc monomer 2

SEQ ID NO: 50 - protein, 231 aa, Artificial Sequence; identical to SEQ ID NO: 27
  Description of Artificial Sequence: Synthetic polypeptide
  IL-15/Ralpha-Fc monomer 1

SEQ ID NO: 51 - protein, 231 aa, Artificial Sequence
  Description of Artificial Sequence: Synthetic polypeptide
  IL-15/Ralpha-Fc monomer 2
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 52 - protein, 350 aa, Artificial Sequence
  Description of Artificial Sequence: Synthetic polypeptide
  XENP20818 Chain 1 - human_IL15_(GGGGS)1_Fc(216)_IgG1_pI(-)_ Isosteric_A_C220S/PVA_/S267K/L368D/K370S (15902)
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 53 - protein, 114 aa, Artificial Sequence; identical to SEQ ID NO: 2
  Description of Artificial Sequence: Synthetic polypeptide
  XENP20818 Human IL15

SEQ ID NO: 54 - protein, 231 aa, Artificial Sequence; identical to SEQ ID NO: 27
  Description of Artificial Sequence: Synthetic polypeptide
  Fc Chain of XENP20818

SEQ ID NO: 55 - protein, 301 aa, Artificial Sequence
  Description of Artificial Sequence: Synthetic polypeptide
  XENP20818 Chain 2 - human_IL15Ralpha(Sushi)_(GGGGS)1_Fc(216)_ IgG1_C220S/PVA_/S267K/S364K/E357Q (15908)
ITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 65 aa, Artificial Sequence; identical to SEQ ID NO: 4
  Description of Artificial Sequence: Synthetic polypeptide
  XENP20818 Human IL15Ralpha(Sushi)

SEQ ID NO: 57 - protein, 231 aa, Artificial Sequence; identical to SEQ ID NO: 26
  Description of Artificial Sequence: Synthetic polypeptide
  Fc Chain of XENP20818

SEQ ID NO: 58 - protein, 345 aa, Artificial Sequence
  Description of Artificial Sequence: Synthetic polypeptide
  XENP21475 Chain 1 - human_IL15-Fc(216)_IgG1_pI(-)_Isosteric_A_ C220S/PVA_/S267K/L368D/K370S (16479)
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 59 - protein, 114 aa, Artificial Sequence; identical to SEQ ID NO: 2
  Description of Artificial Sequence: Synthetic polypeptide
  XENP21475 Human IL15

SEQ ID NO: 60 - protein, 231 aa, Artificial Sequence; identical to SEQ ID NO: 27
  Description of Artificial Sequence: Synthetic polypeptide
  Fc Chain of XENP21475

SEQ ID NO: 61 - protein, 296 aa, Artificial Sequence
  Description of Artificial Sequence: Synthetic polypeptide
  XENP21475 Chain 2 - human_IL15Ralpha(Sushi)-Fc(216)_IgG1_ C220S/PVA_/S267K/S364K/E357Q (16481)
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 65 aa, Artificial Sequence; identical to SEQ ID NO: 4
  Description of Artificial Sequence: Synthetic polypeptide
  XENP21475 Human IL15Ralpha(Sushi)

SEQ ID NO: 63 - protein, 231 aa, Artificial Sequence; identical to SEQ ID NO: 26
  Description of Artificial Sequence: Synthetic polypeptide
  Fc Chain of XENP21475

SEQ ID NO: 64 - protein, 440 aa, Artificial Sequence
  Description of Artificial Sequence: Synthetic polypeptide
  XENP21478 Chain 1 - human_IL15Ralpha(sushi)_(GGGGS)6-human_ IL15-Fc(216)_IgG1_pI(-)_Isosteric_A_C220S/PVA_/S267K/L368D /K370S (16478)
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 65 - protein, 65 aa, Artificial Sequence; identical to SEQ ID NO: 4
  Description of Artificial Sequence: Synthetic polypeptide
  XENP21478 Human IL15Ralpha(Sushi)

SEQ ID NO: 66 - protein, 114 aa, Artificial Sequence; identical to SEQ ID NO: 2
  Description of Artificial Sequence: Synthetic polypeptide
  XENP21478 Human IL15

SEQ ID NO: 67 - protein, 231 aa, Artificial Sequence; identical to SEQ ID NO: 27
  Description of Artificial Sequence: Synthetic polypeptide
  Fc Chain of XENP21478

SEQ ID NO: 68 - protein, 231 aa, Artificial Sequence; identical to SEQ ID NO: 26
  Description of Artificial Sequence: Synthetic polypeptide
  XENP21478 Chain 2 - empty-Fc(216)_IgG1_C220S/PVA_ /S267K/S364K/E357Q (8924)

SEQ ID NO: 69 - protein, 114 aa, Artificial Sequence; identical to SEQ ID NO: 2
  Description of Artificial Sequence: Synthetic polypeptide
  XENP21479 Chain 1 - human_IL15_no_tag (16484)

SEQ ID NO: 70 - protein, 231 aa, Artificial Sequence; identical to SEQ ID NO: 27
  Description of Artificial Sequence: Synthetic polypeptide
  XENP21479 Chain 2 - empty-Fc(216)_IgG1_pI(-)_Isosteric_A_ C220S/PVA_/S267K/L368D/K370S (8793)

SEQ ID NO: 71 - protein, 296 aa, Artificial Sequence; identical to SEQ ID NO: 61
  Description of Artificial Sequence: Synthetic polypeptide
  XENP21479 Chain 3 - human_IL15Ralpha(Sushi)-Fc(216)_IgG1_ C220S/PVA_/S267K/S364K/E357Q (16481)

SEQ ID NO: 72 - protein, 65 aa, Artificial Sequence; identical to SEQ ID NO: 4
  Description of Artificial Sequence: Synthetic polypeptide
  XENP21479 Human IL15Ralpha(Sushi)

SEQ ID NO: 73 - protein, 231 aa, Artificial Sequence; identical to SEQ ID NO: 26
  Description of Artificial Sequence: Synthetic polypeptide
  Fc Chain of XENP21479

SEQ ID NO: 74 - protein, 114 aa, Artificial Sequence; identical to SEQ ID NO: 2
  Description of Artificial Sequence: Synthetic polypeptide
  XENP022366 Chain 1 - human_IL15_no_tag (16484)

SEQ ID NO: 75 - protein, 231 aa, Artificial Sequence; identical to SEQ ID NO: 27
  Description of Artificial Sequence: Synthetic polypeptide
  XENP022366 Chain 2 - empty-Fc(216)_IgG1_pI(-)_Isosteric_A_ C220S/PVA_/S267K/L368D/K370S (8793)

SEQ ID NO: 76 - protein, 301 aa, Artificial Sequence; identical to SEQ ID NO: 55
  Description of Artificial Sequence: Synthetic polypeptide
  XENP022366 Chain 3 - human_IL15Ralpha(Sushi)_(GGGGS)1_Fc(216)_ IgG1_C220S/PVA_/S267K/S364K/E357Q (15908)

SEQ ID NO: 77 - protein, 65 aa, Artificial Sequence; identical to SEQ ID NO: 4
  Description of Artificial Sequence: Synthetic polypeptide
  XENP022366 Human IL15Ralpha(Sushi)

SEQ ID NO: 78 - protein, 231 aa, Artificial Sequence; identical to SEQ ID NO: 26
  Description of Artificial Sequence: Synthetic polypeptide
  Fc Chain of XENP022366

SEQ ID NO: 79 - protein, 114 aa, Artificial Sequence; identical to SEQ ID NO: 2
  Description of Artificial Sequence: Synthetic polypeptide
  XENP024348 Chain 1 - IL15 WT

SEQ ID NO: 80 - protein, 296 aa, Artificial Sequence
  Description of Artificial Sequence: Synthetic polypeptide
  XENP024348 Chain 2 - human_IL15Ralpha(Sushi)_Fc(216)_IgG1_ pI(-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 81 - protein, 65 aa, Artificial Sequence; identical to SEQ ID NO: 4
  Description of Artificial Sequence: Synthetic polypeptide
  XENP024348 Human IL15Ralpha(Sushi)

SEQ ID NO: 82 - protein, 231 aa, Artificial Sequence; identical to SEQ ID NO: 27
  Description of Artificial Sequence: Synthetic polypeptide
  Fc Chain of XENP024348

SEQ ID NO: 83 - protein, 231 aa, Artificial Sequence; identical to SEQ ID NO: 26
  Description of Artificial Sequence: Synthetic polypeptide
  XENP024348 Chain 3 - empty_ Fc(216)_IgG1_C220S/PVA_ /S267K/S364K/E357Q

SEQ ID NO: 84 - protein, 296 aa, Artificial Sequence
  Description of Artificial Sequence: Synthetic polypeptide
  XENP021978 Chain 1 - human_IL15Ralpha(Sushi)-Fc(216)_IgG1_ C220S/PVA_/S267K (17023)
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 65 aa, Artificial Sequence; identical to SEQ ID NO: 4
  Description of Artificial Sequence: Synthetic polypeptide
  XENP021978 Human IL15Ralpha(Sushi)

SEQ ID NO: 86 - protein, 231 aa, Artificial Sequence; identical to SEQ ID NO: 48
  Description of Artificial Sequence: Synthetic polypeptide
  Fc Chain of XENP021978

SEQ ID NO: 87 - protein, 114 aa, Artificial Sequence; identical to SEQ ID NO: 2
  Description of Artificial Sequence: Synthetic polypeptide
  XENP021978 Chain 2 - human_IL15_no_tag (16484)

SEQ ID NO: 88 - protein, 415 aa, Artificial Sequence
  Description of Artificial Sequence: Synthetic polypeptide
  human_IL15Ralpha(sushi)(single-chain)-human_IL15_Fc(216)_IgG1_ C220S/PVA_/S267K
ITCPPPMSVEHADIWVKSYSLYSRERYICNSGFKRKAGTSSLTECVLNKATNVAHWTTPSLKCIRGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - protein, 65 aa, Artificial Sequence; identical to SEQ ID NO: 4
  Description of Artificial Sequence: Synthetic polypeptide
  human_IL15Ralpha(sushi)(single-chain)-human_IL15_Fc(216)_IgG1_ C220S/PVA_/S267K Human IL15Ralpha(Sushi)

SEQ ID NO: 90 - protein, 114 aa, Artificial Sequence; identical to SEQ ID NO: 2
  Description of Artificial Sequence: Synthetic polypeptide
  human_IL15Ralpha(sushi)(single-chain)-human_IL15_Fc(216)_IgG1_ C220S/PVA_/S267K Human IL15

SEQ ID NO: 91 - protein, 231 aa, Artificial Sequence; identical to SEQ ID NO: 48
  Description of Artificial Sequence: Synthetic polypeptide
  Fc Chain of human_IL15Ralpha(sushi)(single-chain)-human_IL15_ Fc(216)_IgG1_C220S/PVA_/S267K

SEQ ID NO: 92 - protein, 306 aa, Artificial Sequence
  Description of Artificial Sequence: Synthetic polypeptide
  XENP022637 Chain 1 - empty- Fc(216)_IgG1_pI(-)_Isosteric_A_ C220S/PVA_/S267K/L368D/K370S_(GGGGS)2_IL15Ralpha(Sushi) (17603)
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIR

SEQ ID NO: 93 - protein, 231 aa, Artificial Sequence; identical to SEQ ID NO: 27
  Description of Artificial Sequence: Synthetic polypeptide
  Fc Chain of XENP022637

SEQ ID NO: 94 - protein, 65 aa, Artificial Sequence; identical to SEQ ID NO: 4
  Description of Artificial Sequence: Synthetic polypeptide
  XENP022637 IL15Ralpha(Sushi)

SEQ ID NO: 95 - protein, 231 aa, Artificial Sequence; identical to SEQ ID NO: 51
  Description of Artificial Sequence: Synthetic polypeptide
  XENP022637 Chain 2 - empty-Fc(216)_IgG1_ISO(+RR)_C220S/PVA_ /S267K/S364K/E357Q (8927)

SEQ ID NO: 96 - protein, 114 aa, Artificial Sequence; identical to SEQ ID NO: 2
  Description of Artificial Sequence: Synthetic polypeptide
  XENP022637 Chain 3 - human_IL15_no_tag (16484)

SEQ ID NO: 97 - protein, 425 aa, Artificial Sequence
  Description of Artificial Sequence: Synthetic polypeptide
  Chain 1 - empty-Fc(216)_IgG1_pI(-)_Isosteric_A_C220S/PVA_ /S267K/L368D/K370S_(GGGGS)2_IL15Ralpha(Sushi)_IL15(single -chain)
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 98 - protein, 231 aa, Artificial Sequence; identical to SEQ ID NO: 27
  Description of Artificial Sequence: Synthetic polypeptide
  Fc Chain of Chain 1 - empty-Fc(216)_IgG1_pI(-)_Isosteric_A_ C220S/PVA_/S267K/L368D/K370S_(GGGGS)2_IL15Ralpha(Sushi)_ IL15(single-chain)

SEQ ID NO: 99 - protein, 65 aa, Artificial Sequence; identical to SEQ ID NO: 4
  Description of Artificial Sequence: Synthetic polypeptide
  Chain 1 - empty-Fc(216)_IgG1_pI(-)_Isosteric_A_C220S/PVA_ /S267K/L368D/K370S_(GGGGS)2_IL15Ralpha(Sushi)_IL15(single- chain) IL15Ralpha(Sushi)

SEQ ID NO: 100 - protein, 114 aa, Artificial Sequence; identical to SEQ ID NO: 2
  Description of Artificial Sequence: Synthetic polypeptide
  Chain 1 - empty-Fc(216)_IgG1_pI(-)_Isosteric_A_C220S/PVA_ /S267K/L368D/K370S_(GGGGS)2_IL15Ralpha(Sushi)_IL15(single -chain) IL15

SEQ ID NO: 101 - protein, 231 aa, Artificial Sequence; identical to SEQ ID NO: 51
  Description of Artificial Sequence: Synthetic polypeptide
  Chain 2 - empty-Fc(216)_IgG1_ISO(+RR)_C220S/PVA_ /S267K/S364K/E357Q (8927)

SEQ ID NO: 102 - protein, 66 aa, Artificial Sequence
  Description of Artificial Sequence: Synthetic polypeptide
  IL-15Ralpha(sushi-D96)
ITCPPPMSVEHADIWVKSYSLYSRERYICNSGFKRKAGTSSLTECVLNKATNVAHWTTPSLKCIRD

SEQ ID NO: 103 - protein, 67 aa, Artificial Sequence
  Description of Artificial Sequence: Synthetic polypeptide
  IL-15Ralpha(sushi-D96/P97)
ITCPPPMSVEHADIWVKSYSLYSRERYICNSGFKRKAGTSSLTECVLNKATNVAHWTTPSLKCIRDP

SEQ ID NO: 104 - protein, 68 aa, Artificial Sequence
  Description of Artificial Sequence: Synthetic polypeptide
  IL-15Ralpha(sushi-D96/P97/A98)
ITCPPPMSVEHADIWVKSYSLYSRERYICNSGFKRKAGTSSLTECVLNKATNVAHWTTPSLKCIRDPA

SEQ ID NO: 105 - protein, 114 aa, Artificial Sequence
  Description of Artificial Sequence: Synthetic polypeptide
  IL-15(E87C)
NWVNVISDLKKIEDLIQSMHIDATLYTESDVHPSCKVTAMKCFLLELQVISLESGDASIHDTVENLIILANNSLSSNGNVTESGCKCCEELEEKNIKEFLQSFVHIVQMFINTS

SEQ ID NO: 106 - protein, 114 aa, Artificial Sequence
  Description of Artificial Sequence: Synthetic polypeptide
  IL-15(V49C)
NWVNVISDLKKIEDLIQSMHIDATLYTESDVHPSCKVTAMKCFLLELQCISLESGDASIHDTVENLIILANNSLSSNGNVTESGCKECEELEEKNIKEFLQSFVHIVQMFINTS

SEQ ID NO: 107 - protein, 114 aa, Artificial Sequence
  Description of Artificial Sequence: Synthetic polypeptide
  IL-15(L52C)
NWVNVISDLKKIEDLIQSMHIDATLYTESDVHPSCKVTAMKCFLLELQVISCESGDASIHDTVENLIILANNSLSSNGNVTESGCKECEELEEKNIKEFLQSFVHIVQMFINTS

SEQ ID NO: 108 - protein, 114 aa, Artificial Sequence
  Description of Artificial Sequence: Synthetic polypeptide
  IL-15(E89C)
NWVNVISDLKKIEDLIQSMHIDATLYTESDVHPSCKVTAMKCFLLELQVISLESGDASIHDTVENLIILANNSLSSNGNVTESGCKECCELEEKNIKEFLQSFVHIVQMFINTS

SEQ ID NO: 109 - protein, 114 aa, Artificial Sequence
  Description of Artificial Sequence: Synthetic polypeptide
  IL-15(Q48C)
NWVNVISDLKKIEDLIQSMHIDATLYTESDVHPSCKVTAMKCFLLELCVISLESGDASIHDTVENLIILANNSLSSNGNVTESGCKECEELEEKNIKEFLQSFVHIVQMFINTS

SEQ ID NO: 110 - protein, 114 aa, Artificial Sequence
  Description of Artificial Sequence: Synthetic polypeptide
  IL-15(E53C)
NWVNVISDLKKIEDLIQSMHIDATLYTESDVHPSCKVTAMKCFLLELQVISLCSGDASIHDTVENLIILANNSLSSNGNVTESGCKECEELEEKNIKEFLQSFVHIVQMFINTS

SEQ ID NO: 111 - protein, 114 aa, Artificial Sequence
  Description of Artificial Sequence: Synthetic polypeptide
  IL-15(C42S)
NWVNVISDLKKIEDLIQSMHIDATLYTESDVHPSCKVTAMKSFLLELQVISLESGDASIHDTVENLIILANNSLSSNGNVTESGCKECEELEEKNIKEFLQSFVHIVQMFINTS

SEQ ID NO: 112 - protein, 114 aa, Artificial Sequence
  Description of Artificial Sequence: Synthetic polypeptide
  IL-15(L45C)
NWVNVISDLKKIEDLIQSMHIDATLYTESDVHPSCKVTAMKCFLCELQVISLESGDASIHDTVENLIILANNSLSSNGNVTESGCKECEELEEKNIKEFLQSFVHIVQMFINTS

SEQ ID NO: 113 - protein, 67 aa, Artificial Sequence
  Description of Artificial Sequence: Synthetic polypeptide
  IL-15Ralpha(sushi-D96/C97)
ITCPPPMSVEHADIWVKSYSLYSRERYICNSGFKRKAGTSSLTECVLNKATNVAHWTTPSLKCIRDC

SEQ ID NO: 114 - protein, 68 aa, Artificial Sequence
  Description of Artificial Sequence: Synthetic polypeptide
  IL-15Ralpha(sushi-D96/P97/C98)
ITCPPPMSVEHADIWVKSYSLYSRERYICNSGFKRKAGTSSLTECVLNKATNVAHWTTPSLKCIRDPC

SEQ ID NO: 115 - protein, 68 aa, Artificial Sequence
  Description of Artificial Sequence: Synthetic polypeptide
  IL-15Ralpha(sushi-D96/C97/A98)
ITCPPPMSVEHADIWVKSYSLYSRERYICNSGFKRKAGTSSLTECVLNKATNVAHWTTPSLKCIRDCA

SEQ ID NO: 116 - protein, 65 aa, Artificial Sequence
  Description of Artificial Sequence: Synthetic polypeptide
  IL-15Ralpha(sushi-S40C)
ITCPPPMSVEHADIWVKSYSLYSRERYICNSGFKRKAGTCSLTECVLNKATNVAHWTTPSLKCIR

SEQ ID NO: 117 - protein, 65 aa, Artificial Sequence
  Description of Artificial Sequence: Synthetic polypeptide
  IL-15Ralpha(sushi-K34C)
ITCPPPMSVEHADIWVKSYSLYSRERYICNSGFCRKAGTSSLTECVLNKATNVAHWTTPSLKCIR

SEQ ID NO: 118 - protein, 65 aa, Artificial Sequence
  Description of Artificial Sequence: Synthetic polypeptide
  IL-15Ralpha(sushi-G38C)
ITCPPPMSVEHADIWVKSYSLYSRERYICNSGFKRKACTSSLTECVLNKATNVAHWTTPSLKCIR

SEQ ID NO: 119 - protein, 65 aa, Artificial Sequence
  Description of Artificial Sequence: Synthetic polypeptide
  IL-15Ralpha(sushi-L42C)
ITCPPPMSVEHADIWVKSYSLYSRERYICNSGFKRKAGTSSCTECVLNKATNVAHWTTPSLKCIR

SEQ ID NO: 120 - protein, 65 aa, Artificial Sequence
  Description of Artificial Sequence: Synthetic polypeptide
  IL-15Ralpha(sushi-A37C)
ITCPPPMSVEHADIWVKSYSLYSRERYICNSGFKRKCGTSSLTECVLNKATNVAHWTTPSLKCIR

SEQ ID NO: 121 - protein, 114 aa, Artificial Sequence; identical to SEQ ID NO: 2
  Description of Artificial Sequence: Synthetic polypeptide
  XENP021996 Chain 1 - human_IL15_no_tag (16484)

SEQ ID NO: 122 - protein, 65 aa, Artificial Sequence; identical to SEQ ID NO: 4
  Description of Artificial Sequence: Synthetic polypeptide
  XENP021996 Chain 2 - human_IL15Ralpha(Sushi) (17033)

SEQ ID NO: 123 - protein, 114 aa, Artificial Sequence; identical to SEQ ID NO: 2
  Description of Artificial Sequence: Synthetic polypeptide
  XENP022004 Chain 1 - human_IL15_E87C_no_tag (17074)

SEQ ID NO: 124 - protein, 67 aa, Artificial Sequence; identical to SEQ ID NO: 113
  Description of Artificial Sequence: Synthetic polypeptide
  XENP022004 Chain 2 - human_IL15Ralpha(Sushi-D96/C97) (17051)

SEQ ID NO: 125 - protein, 114 aa, Artificial Sequence; identical to SEQ ID NO: 2
  Description of Artificial Sequence: Synthetic polypeptide
  XENP022005 Chain 1 - human_IL15_E87C_no_tag (17074)

SEQ ID NO: 126 - protein, 68 aa, Artificial Sequence; identical to SEQ ID NO: 114
  Description of Artificial Sequence: Synthetic polypeptide
  XENP022005 Chain 2 - human_ IL15Ralpha(Sushi-D96/P97/C98) (17052)

SEQ ID NO: 127 - protein, 114 aa, Artificial Sequence; identical to SEQ ID NO: 2
  Description of Artificial Sequence: Synthetic polypeptide
  XENP022006 Chain 1 - human_IL15_E87C_no_tag (17074)

SEQ ID NO: 128 - protein, 68 aa, Artificial Sequence; identical to SEQ ID NO: 115
  Description of Artificial Sequence: Synthetic polypeptide
  XENP022006 Chain 2 - human_ IL15Ralpha(Sushi-D96/C97/A98) (17053)

SEQ ID NO: 129 - protein, 114 aa, Artificial Sequence; identical to SEQ ID NO: 107
  Description of Artificial Sequence: Synthetic polypeptide
  XENP022008 Chain 1 - human_IL15_L52C_no_tag (17072)

SEQ ID NO: 130 - protein, 65 aa, Artificial Sequence; identical to SEQ ID NO: 116
  Description of Artificial Sequence: Synthetic polypeptide
  XENP022008 Chain 2 - human_IL15Ralpha(Sushi-S40C) (17057)

SEQ ID NO: 131 - protein, 114 aa, Artificial Sequence; identical to SEQ ID NO: 112
  Description of Artificial Sequence: Synthetic polypeptide
  XENP022494 Chain 1 - human_IL15_L45C_no_tag (17069)

SEQ ID NO: 132 - protein, 65 aa, Artificial Sequence; identical to SEQ ID NO: 120
  Description of Artificial Sequence: Synthetic polypeptide
  XENP022494 Chain 2 - human_IL15Ralpha(Sushi-A37C) (17055)

SEQ ID NO: 133 - protein, 209 aa, Artificial Sequence
  Description of Artificial Sequence: Synthetic polypeptide
  XENP022049 human_IL15Ralpha(sushi)_(GGGGS)6-human_IL15-sc
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 134 - protein, 65 aa, Artificial Sequence; identical to SEQ ID NO: 4
  Description of Artificial Sequence: Synthetic polypeptide
  XENP022049 Human IL15Ralpha(Sushi)

SEQ ID NO: 135 - protein, 114 aa, Artificial Sequence; identical to SEQ ID NO: 2
  Description of Artificial Sequence: Synthetic polypeptide
  XENP022049 Human IL15

SEQ ID NO: 136 - protein, 350 aa, Artificial Sequence
  Description of Artificial Sequence: Synthetic polypeptide
  XENP022013 Chain 1 - human_IL15_E87C_(GGGGS)1_Fc(216)_IgG1_ pI(-)_Isosteric_A_C220S/PVA_/S267K/L368D/K370S
NWVNVISDLKKIEDLIQSMHIDATLYTESDVHPSCKVTAMKCFLLELQVISLESGDASIHDTVENLIILANNSLSSNGNVTESGCKCCEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 137 - protein, 114 aa, Artificial Sequence; identical to SEQ ID NO: 105
  Description of Artificial Sequence: Synthetic polypeptide
  XENP022013 Human IL15

SEQ ID NO: 138 - protein, 231 aa, Artificial Sequence; identical to SEQ ID NO: 27
  Description of Artificial Sequence: Synthetic polypeptide
  Fc Chain of  XENP022013

SEQ ID NO: 139 - protein, 303 aa, Artificial Sequence
  Description of Artificial Sequence: Synthetic polypeptide
  XENP022013 Chain 2 - human_IL15Ralpha(Sushi-D96/C97)_(GGGGS)1_ Fc(216)_IgG1_C220S/PVA_/S267K/S364K/E357Q
ITCPPPMSVEHADIWVKSYSLYSRERYICNSGFKRKAGTSSLTECVLNKATNVAHWTTPSLKCIRDCGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 140 - protein, 67 aa, Artificial Sequence; identical to SEQ ID NO: 113
  Description of Artificial Sequence: Synthetic polypeptide
  XENP022013 Human IL15Ralpha(Sushi)

SEQ ID NO: 141 - protein, 231 aa, Artificial Sequence; identical to SEQ ID NO: 26
  Description of Artificial Sequence: Synthetic polypeptide
  Fc Chain of  XENP022013

SEQ ID NO: 142 - protein, 350 aa, Artificial Sequence; identical to SEQ ID NO: 136
  Description of Artificial Sequence: Synthetic polypeptide
  XENP022014 Chain 1 - human_IL15_E87C_(GGGGS)1_Fc(216)_IgG1_ pI(-)_Isosteric_A_C220S/PVA_/S267K/L368D/K370S

SEQ ID NO: 143 - protein, 114 aa, Artificial Sequence; identical to SEQ ID NO: 105
  Description of Artificial Sequence: Synthetic polypeptide
  XENP022014 Human IL15

SEQ ID NO: 144 - protein, 231 aa, Artificial Sequence; identical to SEQ ID NO: 27
  Description of Artificial Sequence: Synthetic polypeptide
  Fc Chain of  XENP022014

SEQ ID NO: 145 - protein, 304 aa, Artificial Sequence
  Description of Artificial Sequence: Synthetic polypeptide
  XENP022014 Chain 2 - human_IL15Ralpha(Sushi-D96/P97/C98)_ (GGGGS)1_Fc(216)_IgG1_C220S/PVA_/S267K/S364K/E357Q
ITCPPPMSVEHADIWVKSYSLYSRERYICNSGFKRKAGTSSLTECVLNKATNVAHWTTPSLKCIRDPCGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 146 - protein, 68 aa, Artificial Sequence; identical to SEQ ID NO: 114
  Description of Artificial Sequence: Synthetic polypeptide
  XENP022014 Human IL15Ralpha(Sushi)

SEQ ID NO: 147 - protein, 231 aa, Artificial Sequence; identical to SEQ ID NO: 26
  Description of Artificial Sequence: Synthetic polypeptide
  Fc Chain of  XENP022014

SEQ ID NO: 148 - protein, 350 aa, Artificial Sequence; identical to SEQ ID NO: 136
  Description of Artificial Sequence: Synthetic polypeptide
  XENP022015 Chain 1 - human_IL15_E87C_(GGGGS)1_Fc(216)_IgG1_ pI(-)_Isosteric_A_C220S/PVA_/S267K/L368D/K370S

SEQ ID NO: 149 - protein, 114 aa, Artificial Sequence; identical to SEQ ID NO: 105
  Description of Artificial Sequence: Synthetic polypeptide
  XENP022015 Human IL15

SEQ ID NO: 150 - protein, 231 aa, Artificial Sequence; identical to SEQ ID NO: 27
  Description of Artificial Sequence: Synthetic polypeptide
  Fc Chain of  XENP022015

SEQ ID NO: 151 - protein, 304 aa, Artificial Sequence
  Description of Artificial Sequence: Synthetic polypeptide
  XENP022015 Chain 2 - human_IL15Ralpha(Sushi-D96/C97/A98)_ (GGGGS)1_Fc(216)_IgG1_C220S/PVA_/S267K/S364K/E357Q
ITCPPPMSVEHADIWVKSYSLYSRERYICNSGFKRKAGTSSLTECVLNKATNVAHWTTPSLKCIRDCAGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 152 - protein, 68 aa, Artificial Sequence; identical to SEQ ID NO: 115
  Description of Artificial Sequence: Synthetic polypeptide
  XENP022015 Human IL15Ralpha(Sushi)

SEQ ID NO: 153 - protein, 231 aa, Artificial Sequence; identical to SEQ ID NO: 26
  Description of Artificial Sequence: Synthetic polypeptide
  Fc Chain of  XENP022015

SEQ ID NO: 154 - protein, 350 aa, Artificial Sequence
  Description of Artificial Sequence: Synthetic polypeptide
  XENP022017 Chain 1 - human_IL15_L52C_(GGGGS)1-_Fc(216)_IgG1_ pI(-)_Isosteric_A_C220S/PVA_/S267K/L368D/K370S
NWVNVISDLKKIEDLIQSMHIDATLYTESDVHPSCKVTAMKCFLLELQVISCESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 155 - protein, 114 aa, Artificial Sequence; identical to SEQ ID NO: 107
  Description of Artificial Sequence: Synthetic polypeptide
  XENP022017 Human IL15

SEQ ID NO: 156 - protein, 231 aa, Artificial Sequence; identical to SEQ ID NO: 27
  Description of Artificial Sequence: Synthetic polypeptide
  Fc Chain of  XENP022017

SEQ ID NO: 157 - protein, 301 aa, Artificial Sequence
  Description of Artificial Sequence: Synthetic polypeptide
  XENP022017 Chain 2 - human_IL15Ralpha(Sushi-S40C)_(GGGGS)1_ Fc(216)_IgG1_C220S/PVA_/S267K/S364K/E357Q
ITCPPPMSVEHADIWVKSYSLYSRERYICNSGFKRKAGTCSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 158 - protein, 65 aa, Artificial Sequence; identical to SEQ ID NO: 116
  Description of Artificial Sequence: Synthetic polypeptide
  XENP022017 Human IL15Ralpha(Sushi)

SEQ ID NO: 159 - protein, 231 aa, Artificial Sequence; identical to SEQ ID NO: 26
  Description of Artificial Sequence: Synthetic polypeptide
  Fc Chain of  XENP022017

SEQ ID NO: 160 - protein, 114 aa, Artificial Sequence; identical to SEQ ID NO: 105
  Description of Artificial Sequence: Synthetic polypeptide
  XENP022358 Chain 1 - human_IL15_E87C_no_tag (17074)

SEQ ID NO: 161 - protein, 231 aa, Artificial Sequence; identical to SEQ ID NO: 27
  Description of Artificial Sequence: Synthetic polypeptide
  XENP022358 Chain 2 - empty-Fc(216)_IgG1_pI(-)_Isosteric_A_ C220S/PVA_/S267K/L368D/K370S (8793)

SEQ ID NO: 162 - protein, 304 aa, Artificial Sequence; identical to SEQ ID NO: 145
  Description of Artificial Sequence: Synthetic polypeptide
  XENP022358 Chain 3 - human_IL15Ralpha(Sushi-D96/P97/C98)_ (GGGGS)1_Fc(216)_IgG1_C220S/PVA_/S267K/S364K/E357Q (17039)

SEQ ID NO: 163 - protein, 68 aa, Artificial Sequence; identical to SEQ ID NO: 114
  Description of Artificial Sequence: Synthetic polypeptide
  XENP022358 Human IL15Ralpha(Sushi)

SEQ ID NO: 164 - protein, 231 aa, Artificial Sequence; identical to SEQ ID NO: 26
  Description of Artificial Sequence: Synthetic polypeptide
  Fc Chain of  XENP022358

SEQ ID NO: 165 - protein, 114 aa, Artificial Sequence; identical to SEQ ID NO: 105
  Description of Artificial Sequence: Synthetic polypeptide
  XENP022359 Chain 1 - human_IL15_E87C_no_tag (17074)

SEQ ID NO: 166 - protein, 231 aa, Artificial Sequence; identical to SEQ ID NO: 27
  Description of Artificial Sequence: Synthetic polypeptide
  XENP022359 Chain 2 - empty-Fc(216)_IgG1_pI(-)_Isosteric_A_ C220S/PVA_/S267K/L368D/K370S (8793)

SEQ ID NO: 167 - protein, 304 aa, Artificial Sequence; identical to SEQ ID NO: 151
  Description of Artificial Sequence: Synthetic polypeptide
  XENP022359 Chain 3 - human_IL15Ralpha(Sushi-D96/C97/A98)_ (GGGGS)1_Fc(216)_IgG1_C220S/PVA_/S267K/S364K/E357Q (17040)

SEQ ID NO: 168 - protein, 68 aa, Artificial Sequence; identical to SEQ ID NO: 115
  Description of Artificial Sequence: Synthetic polypeptide
  XENP022359 Human IL15Ralpha(Sushi)

SEQ ID NO: 169 - protein, 231 aa, Artificial Sequence; identical to SEQ ID NO: 26
  Description of Artificial Sequence: Synthetic polypeptide
  Fc Chain of  XENP022359

SEQ ID NO: 170 - protein, 114 aa, Artificial Sequence; identical to SEQ ID NO: 107
  Description of Artificial Sequence: Synthetic polypeptide
  XENP022361 Chain 1 - human_IL15_L52C_no_tag (17072)

SEQ ID NO: 171 - protein, 231 aa, Artificial Sequence; identical to SEQ ID NO: 27
  Description of Artificial Sequence: Synthetic polypeptide
  XENP022361 Chain 2 - empty-Fc(216)_IgG1_pI(-)_Isosteric_A_ C220S/PVA_/S267K/L368D/K370S (8793)

SEQ ID NO: 172 - protein, 301 aa, Artificial Sequence; identical to SEQ ID NO: 157
  Description of Artificial Sequence: Synthetic polypeptide
  XENP022361 Chain 3 - human_IL15Ralpha(Sushi-S40C)_(GGGGS)1_ Fc(216)_IgG1_C220S/PVA_/S267K/S364K/E357Q (17044)

SEQ ID NO: 173 - protein, 65 aa, Artificial Sequence; identical to SEQ ID NO: 116
  Description of Artificial Sequence: Synthetic polypeptide
  XENP022361 Human IL15Ralpha(Sushi)

SEQ ID NO: 174 - protein, 231 aa, Artificial Sequence; identical to SEQ ID NO: 26
  Description of Artificial Sequence: Synthetic polypeptide
  Fc Chain of  XENP022361

SEQ ID NO: 175 - protein, 114 aa, Artificial Sequence; identical to SEQ ID NO: 105
  Description of Artificial Sequence: Synthetic polypeptide
  XENP022684 Chain 1 - IL15_E87C

SEQ ID NO: 176 - protein, 299 aa, Artificial Sequence
  Description of Artificial Sequence: Synthetic polypeptide
  XENP022684 Chain 2 - IL15Ralpha(Sushi-D96/C97/A98)_Fc(216)_ IgG1_pI(-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIRDCAEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 177 - protein, 68 aa, Artificial Sequence; identical to SEQ ID NO: 115
  Description of Artificial Sequence: Synthetic polypeptide
  XENP022684 IL15Ralpha(Sushi)

SEQ ID NO: 178 - protein, 231 aa, Artificial Sequence; identical to SEQ ID NO: 26
  Description of Artificial Sequence: Synthetic polypeptide
  Fc Chain of  XENP022684

SEQ ID NO: 179 - protein, 298 aa, Artificial Sequence
  Description of Artificial Sequence: Synthetic polypeptide
  XENP022634 Chain 1 - human_IL15Ralpha(Sushi-D96/C97)- Fc(216)_IgG1_C220S/PVA_/S267K (17581)
ITCPPPMSVEHADIWVKSYSLYSRERYICNSGFKRKAGTSSLTECVLNKATNVAHWTTPSLKCIRDCEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - protein, 67 aa, Artificial Sequence; identical to SEQ ID NO: 113
  Description of Artificial Sequence: Synthetic polypeptide
  XENP022634 Human IL15Ralpha(Sushi)

SEQ ID NO: 181 - protein, 231 aa, Artificial Sequence; identical to SEQ ID NO: 48
  Description of Artificial Sequence: Synthetic polypeptide
  Fc Chain of  XENP022634

SEQ ID NO: 182 - protein, 114 aa, Artificial Sequence; identical to SEQ ID NO: 105
  Description of Artificial Sequence: Synthetic polypeptide
  XENP022634 Chain 2 - human_IL15_E87C_no_tag (17074)

SEQ ID NO: 183 - protein, 299 aa, Artificial Sequence
  Description of Artificial Sequence: Synthetic polypeptide
  XENP022635 Chain 1 - human_IL15Ralpha(Sushi-D96/C97/A98) - Fc(216)_IgG1_C220S/PVA_/S267K (17582)
ITCPPPMSVEHADIWVKSYSLYSRERYICNSGFKRKAGTSSLTECVLNKATNVAHWTTPSLKCIRDCAEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 184 - protein, 68 aa, Artificial Sequence; identical to SEQ ID NO: 115
  Description of Artificial Sequence: Synthetic polypeptide
  XENP022635 Human IL15Ralpha(Sushi)

SEQ ID NO: 185 - protein, 231 aa, Artificial Sequence; identical to SEQ ID NO: 48
  Description of Artificial Sequence: Synthetic polypeptide
  Fc Chain of  XENP022635

SEQ ID NO: 186 - protein, 114 aa, Artificial Sequence; identical to SEQ ID NO: 105
  Description of Artificial Sequence: Synthetic polypeptide
  XENP022635 Chain 2 - human_IL15_E87C_no_tag (17074)

SEQ ID NO: 187 - protein, 296 aa, Artificial Sequence
  Description of Artificial Sequence: Synthetic polypeptide
  XENP022636 Chain 1 - human_IL15Ralpha(Sushi-S40C)-Fc(216)_ IgG1_C220S/PVA_/S267K (17583)
ITCPPPMSVEHADIWVKSYSLYSRERYICNSGFKRKAGTCSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 188 - protein, 65 aa, Artificial Sequence; identical to SEQ ID NO: 116
  Description of Artificial Sequence: Synthetic polypeptide
  XENP022636 Human IL15Ralpha(Sushi)

SEQ ID NO: 189 - protein, 231 aa, Artificial Sequence; identical to SEQ ID NO: 48
  Description of Artificial Sequence: Synthetic polypeptide
  Fc Chain of  XENP022636

SEQ ID NO: 190 - protein, 114 aa, Artificial Sequence; identical to SEQ ID NO: 107
  Description of Artificial Sequence: Synthetic polypeptide
  XENP022636 Chain 2 - human_IL15_L52C_no_tag (17072)

SEQ ID NO: 191 - protein, 308 aa, Artificial Sequence
  Description of Artificial Sequence: Synthetic polypeptide
  XENP022639 Chain 1 - empty-Fc(216)_IgG1_pI(-)_Isosteric_A_ C220S/PVA_/S267K/L368D/K370S_(GGGGS)2_IL15Ralpha(Sushi-D96/ C97) (17605)
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRDC

SEQ ID NO: 192 - protein, 231 aa, Artificial Sequence; identical to SEQ ID NO: 27
  Description of Artificial Sequence: Synthetic polypeptide
  Fc Chain of  XENP022639

SEQ ID NO: 193 - protein, 67 aa, Artificial Sequence; identical to SEQ ID NO: 113
  Description of Artificial Sequence: Synthetic polypeptide
  XENP022639  IL15Ralpha(Sushi)

SEQ ID NO: 194 - protein, 231 aa, Artificial Sequence; identical to SEQ ID NO: 51
  Description of Artificial Sequence: Synthetic polypeptide
  XENP022639 Chain 2 - empty-Fc(216)_IgG1_ISO(+RR)_C220S/PVA_ /S267K/S364K/E357Q (8927)

SEQ ID NO: 195 - protein, 114 aa, Artificial Sequence; identical to SEQ ID NO: 105
  Description of Artificial Sequence: Synthetic polypeptide
  XENP022639 Chain 3 - human_IL15_E87C_no_tag (17074)

SEQ ID NO: 196 - protein, 114 aa, Artificial Sequence; identical to SEQ ID NO: 105
  Description of Artificial Sequence: Synthetic polypeptide
  XENP022640 Chain 1 - IL15

SEQ ID NO: 197 - protein, 231 aa, Artificial Sequence; identical to SEQ ID NO: 27
  Description of Artificial Sequence: Synthetic polypeptide
  XENP022640 Chain 2 - empty_Fc(216)_IgG1_pI(-)_Isosteric_A_ C220S/PVA_/S267K/L368D/K370S

SEQ ID NO: 198 - protein, 114 aa, Artificial Sequence
  Description of Artificial Sequence: Synthetic polypeptide
  N1D
DWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 199 - protein, 114 aa, Artificial Sequence
  Description of Artificial Sequence: Synthetic polypeptide
  N4D
NWVDVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 200 - protein, 114 aa, Artificial Sequence
  Description of Artificial Sequence: Synthetic polypeptide
  D8N
NWVNVISNLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 201 - protein, 114 aa, Artificial Sequence
  Description of Artificial Sequence: Synthetic polypeptide
  D30N
NWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTS

SEQ ID NO: 202 - protein, 114 aa, Artificial Sequence
  Description of Artificial Sequence: Synthetic polypeptide
  D61N
NWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 203 - protein, 114 aa, Artificial Sequence
  Description of Artificial Sequence: Synthetic polypeptide
  E64Q
NWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 204 - protein, 114 aa, Artificial Sequence
  Description of Artificial Sequence: Synthetic polypeptide
  N65D
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 205 - protein, 114 aa, Artificial Sequence
  Description of Artificial Sequence: Synthetic polypeptide
  Q108E
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTS

SEQ ID NO: 206 - protein, 114 aa, Artificial Sequence
  Description of Artificial Sequence: Synthetic polypeptide
  N1D/D61N
DWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 207 - protein, 114 aa, Artificial Sequence
  Description of Artificial Sequence: Synthetic polypeptide
  N1D/E64Q
DWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 208 - protein, 114 aa, Artificial Sequence
  Description of Artificial Sequence: Synthetic polypeptide
  N4D/D61N
NWVDVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 209 - protein, 114 aa, Artificial Sequence
  Description of Artificial Sequence: Synthetic polypeptide
  N4D/E64Q
NWVDVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 210 - protein, 114 aa, Artificial Sequence
  Description of Artificial Sequence: Synthetic polypeptide
  D8N/D61N
NWVNVISNLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 211 - protein, 114 aa, Artificial Sequence
  Description of Artificial Sequence: Synthetic polypeptide
  D8N/E64Q
NWVNVISNLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 212 - protein, 114 aa, Artificial Sequence
  Description of Artificial Sequence: Synthetic polypeptide
  D61N/E64Q
NWVNVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVQMFINTS

SEQ ID NO: 213 - protein, 114 aa, Artificial Sequence
  Description of Artificial Sequence: Synthetic polypeptide
  E64Q/Q108E
NWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVEMFINTS

SEQ ID NO: 214 - protein, 114 aa, Artificial Sequence
  Description of Artificial Sequence: Synthetic polypeptide
  N1D/N4D/D8N
DWVDVISNLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 215 - protein, 114 aa, Artificial Sequence
  Description of Artificial Sequence: Synthetic polypeptide
  D61N/E64Q/N65D
NWVNVISDLKKIEDLIQSMHIDATLYTESDVHPSCKVTAMKCFLLELQVISLESGDASIHNTVQDLIILANNSLSSNGNVTESGCKECEELEEKNIKEFLQSFVHIVQMFINTS

SEQ ID NO: 216 - protein, 114 aa, Artificial Sequence
  Description of Artificial Sequence: Synthetic polypeptide
  N1D/D61N/E64Q/Q108E
DWVNVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVEMFINTS

SEQ ID NO: 217 - protein, 114 aa, Artificial Sequence
  Description of Artificial Sequence: Synthetic polypeptide
  N4D/D61N/E64Q/Q108E
NWVDVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVEMFINTS

SEQ ID NO: 218 - protein, 114 aa, Artificial Sequence
  Description of Artificial Sequence: Synthetic polypeptide
  N1D/N65D
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 219 - protein, 114 aa, Artificial Sequence
  Description of Artificial Sequence: Synthetic polypeptide
  N1D/Q108E
DWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTS

SEQ ID NO: 220 - protein, 114 aa, Artificial Sequence
  Description of Artificial Sequence: Synthetic polypeptide
  N4D/N65D
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 221 - protein, 114 aa, Artificial Sequence
  Description of Artificial Sequence: Synthetic polypeptide
  D30N/N65D
NWVNVISDLKKIEDLIQSMHIDATLYTESNVHPSCKVTAMKCFLLELQVISLESGDASIHDTVEDLIILANNSLSSNGNVTESGCKECEELEEKNIKEFLQSFVHIVQMFINTS

SEQ ID NO: 222 - protein, 114 aa, Artificial Sequence
  Description of Artificial Sequence: Synthetic polypeptide
  D30N/Q108E
NWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVEMFINTS

SEQ ID NO: 223 - protein, 114 aa, Artificial Sequence
  Description of Artificial Sequence: Synthetic polypeptide
  N65D/Q108E
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVEMFINTS

SEQ ID NO: 224 - protein, 114 aa, Artificial Sequence
  Description of Artificial Sequence: Synthetic polypeptide
  E64Q/N65D
NWVNVISDLKKIEDLIQSMHIDATLYTESDVHPSCKVTAMKCFLLELQVISLESGDASIHDTVQDLIILANNSLSSNGNVTESGCKECEELEEKNIKEFLQSFVHIVQMFINTS

SEQ ID NO: 225 - protein, 114 aa, Artificial Sequence
  Description of Artificial Sequence: Synthetic polypeptide
  N1D/N4D/N65D
DWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 226 - protein, 114 aa, Artificial Sequence
  Description of Artificial Sequence: Synthetic polypeptide
  D30N/E64Q/N65D
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTS

SEQ ID NO: 227 - protein, 114 aa, Artificial Sequence
  Description of Artificial Sequence: Synthetic polypeptide
  N4D/D61N/N65D
NWVDVISDLKKIEDLIQSMHIDATLYTESDVHPSCKVTAMKCFLLELQVISLESGDASIHNTVEDLIILANNSLSSNGNVTESGCKECEELEEKNIKEFLQSFVHIVQMFINTS

SEQ ID NO: 228 - protein, 350 aa, Artificial Sequence
  Description of Artificial Sequence: Synthetic polypeptide
  XENP022821 Chain 1 - human_IL15_N65D_(GGGGS)1 (17692)
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 229 - protein, 114 aa, Artificial Sequence; identical to SEQ ID NO: 204
  Description of Artificial Sequence: Synthetic polypeptide
  XENP022821 Human IL15

SEQ ID NO: 230 - protein, 231 aa, Artificial Sequence; identical to SEQ ID NO: 27
  Description of Artificial Sequence: Synthetic polypeptide
  Fc Chain of  XENP022821

SEQ ID NO: 231 - protein, 301 aa, Artificial Sequence; identical to SEQ ID NO: 55
  Description of Artificial Sequence: Synthetic polypeptide
  XENP022821 Chain 2 - human_IL15Ralpha(Sushi)_(GGGGS)1_Fc(216)_ IgG1_pI(-)_Isosteric_A_C220S/PVA_/S267K/L368D/K370S- Fc(216) _IgG1_C220S/PVA_/S267K/S364K/E357Q (15908)

SEQ ID NO: 232 - protein, 65 aa, Artificial Sequence; identical to SEQ ID NO: 4
  Description of Artificial Sequence: Synthetic polypeptide
  XENP022821 Human IL15Ralpha(Sushi)

SEQ ID NO: 233 - protein, 231 aa, Artificial Sequence; identical to SEQ ID NO: 26
  Description of Artificial Sequence: Synthetic polypeptide
  Fc Chain of  XENP022821

SEQ ID NO: 234 - protein, 350 aa, Artificial Sequence
  Description of Artificial Sequence: Synthetic polypeptide
  XENP022822 Chain 1 - human_IL15_Q108E_(GGGGS)1 (17693)
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 235 - protein, 114 aa, Artificial Sequence; identical to SEQ ID NO: 205
  Description of Artificial Sequence: Synthetic polypeptide
  XENP022822 Human IL15

SEQ ID NO: 236 - protein, 231 aa, Artificial Sequence; identical to SEQ ID NO: 27
  Description of Artificial Sequence: Synthetic polypeptide
  Fc Chain of  XENP022822

SEQ ID NO: 237 - protein, 301 aa, Artificial Sequence; identical to SEQ ID NO: 55
  Description of Artificial Sequence: Synthetic polypeptide
  XENP022822 Chain 2 - human_IL15Ralpha(Sushi)_(GGGGS)1_Fc(216)_ IgG1_pI(-)_Isosteric_A_C220S/PVA_/S267K/L368D/K370S-Fc(216) _IgG1_C220S/PVA_/S267K/S364K/E357Q (15908)

SEQ ID NO: 238 - protein, 65 aa, Artificial Sequence; identical to SEQ ID NO: 4
  Description of Artificial Sequence: Synthetic polypeptide
  XENP022822 Human IL15Ralpha(Sushi)

SEQ ID NO: 239 - protein, 231 aa, Artificial Sequence; identical to SEQ ID NO: 26
  Description of Artificial Sequence: Synthetic polypeptide
  Fc Chain of  XENP022822

SEQ ID NO: 240 - protein, 350 aa, Artificial Sequence
  Description of Artificial Sequence: Synthetic polypeptide
  XENP023554 Chain 1 - human_IL15_N1D/N65D_(GGGGS)1_Fc(216)_ IgG1_pI(-)_Isosteric_A_C220S/PVA_/S267K/L368D/K370S (18783)
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 241 - protein, 114 aa, Artificial Sequence; identical to SEQ ID NO: 218
  Description of Artificial Sequence: Synthetic polypeptide
  XENP023554 Human IL15

SEQ ID NO: 242 - protein, 231 aa, Artificial Sequence; identical to SEQ ID NO: 27
  Description of Artificial Sequence: Synthetic polypeptide
  Fc Chain of  XENP023554

SEQ ID NO: 243 - protein, 301 aa, Artificial Sequence; identical to SEQ ID NO: 55
  Description of Artificial Sequence: Synthetic polypeptide
  XENP023554 Chain 2 - human_IL15Ralpha(Sushi)_(GGGGS)1_Fc(216)_ IgG1_C220S/PVA_/S267K/S364K/E357Q (15908)

SEQ ID NO: 244 - protein, 65 aa, Artificial Sequence; identical to SEQ ID NO: 4
  Description of Artificial Sequence: Synthetic polypeptide
  XENP023554 Human IL15Ralpha(Sushi)

SEQ ID NO: 245 - protein, 231 aa, Artificial Sequence; identical to SEQ ID NO: 26
  Description of Artificial Sequence: Synthetic polypeptide
  Fc Chain of  XENP023554

SEQ ID NO: 246 - protein, 350 aa, Artificial Sequence
  Description of Artificial Sequence: Synthetic polypeptide
  XENP023557 Chain 1 - human_IL15_N4D/N65D_(GGGGS)1_Fc(216)_IgG1_ pI(-)_Isosteric_A_C220S/PVA_/S267K/L368D/K370S (18786)
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 247 - protein, 114 aa, Artificial Sequence; identical to SEQ ID NO: 220
  Description of Artificial Sequence: Synthetic polypeptide
  XENP023557 Human IL15

SEQ ID NO: 248 - protein, 231 aa, Artificial Sequence; identical to SEQ ID NO: 27
  Description of Artificial Sequence: Synthetic polypeptide
  Fc Chain of  XENP023557

SEQ ID NO: 249 - protein, 301 aa, Artificial Sequence; identical to SEQ ID NO: 55
  Description of Artificial Sequence: Synthetic polypeptide
  XENP023557 Chain 2 - human_IL15Ralpha(Sushi)_(GGGGS)1_Fc(216)_ IgG1_C220S/PVA_/S267K/S364K/E357Q (15908)

SEQ ID NO: 250 - protein, 65 aa, Artificial Sequence; identical to SEQ ID NO: 4
  Description of Artificial Sequence: Synthetic polypeptide
  XENP023557 Human IL15Ralpha(Sushi)

SEQ ID NO: 251 - protein, 231 aa, Artificial Sequence; identical to SEQ ID NO: 26
  Description of Artificial Sequence: Synthetic polypeptide
  Fc Chain of  XENP023557

SEQ ID NO: 252 - protein, 350 aa, Artificial Sequence
  Description of Artificial Sequence: Synthetic polypeptide
  XENP023561 Chain 1 - human_IL15_N65D/Q108E_(GGGGS)1_Fc(216)_ IgG1_pI(-)_Isosteric_A_C220S/PVA_/S267K/L368D/K370S
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 253 - protein, 114 aa, Artificial Sequence; identical to SEQ ID NO: 223
  Description of Artificial Sequence: Synthetic polypeptide
  XENP023561 Human IL15

SEQ ID NO: 254 - protein, 231 aa, Artificial Sequence; identical to SEQ ID NO: 27
  Description of Artificial Sequence: Synthetic polypeptide
  Fc Chain of  XENP023561

SEQ ID NO: 255 - protein, 301 aa, Artificial Sequence; identical to SEQ ID NO: 55
  Description of Artificial Sequence: Synthetic polypeptide
  XENP023561 Chain 2 - human_IL15Ralpha(Sushi)_(GGGGS)1_Fc(216)_ IgG1_C220S/PVA_/S267K/S364K/E357Q

SEQ ID NO: 256 - protein, 65 aa, Artificial Sequence; identical to SEQ ID NO: 4
  Description of Artificial Sequence: Synthetic polypeptide
  XENP023561 Human IL15Ralpha(Sushi)

SEQ ID NO: 257 - protein, 231 aa, Artificial Sequence; identical to SEQ ID NO: 26
  Description of Artificial Sequence: Synthetic polypeptide
  Fc Chain of  XENP023561

SEQ ID NO: 258 - protein, 345 aa, Artificial Sequence
  Description of Artificial Sequence: Synthetic polypeptide
  XENP024018 Chain 1 - human_IL15(N65D)_Fc(216)_IgG1_pI(-)_ Isosteric_A_C220S/PVA_/S267K/L368D/K370S
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 259 - protein, 114 aa, Artificial Sequence; identical to SEQ ID NO: 204
  Description of Artificial Sequence: Synthetic polypeptide
  XENP024018 Human IL15

SEQ ID NO: 260 - protein, 231 aa, Artificial Sequence; identical to SEQ ID NO: 27
  Description of Artificial Sequence: Synthetic polypeptide
  Fc Chain of  XENP024018

SEQ ID NO: 261 - protein, 296 aa, Artificial Sequence; identical to SEQ ID NO: 61
  Description of Artificial Sequence: Synthetic polypeptide
  XENP024018 Chain 2 - human_IL15Ralpha(Sushi)_Fc(216)_IgG1_ C220S/PVA_/S267K/S364K/E357Q

SEQ ID NO: 262 - protein, 65 aa, Artificial Sequence; identical to SEQ ID NO: 4
  Description of Artificial Sequence: Synthetic polypeptide
  XENP024018 Human IL15Ralpha(Sushi)

SEQ ID NO: 263 - protein, 231 aa, Artificial Sequence; identical to SEQ ID NO: 26
  Description of Artificial Sequence: Synthetic polypeptide
  Fc Chain of  XENP024018

SEQ ID NO: 264 - protein, 345 aa, Artificial Sequence
  Description of Artificial Sequence: Synthetic polypeptide
  XENP024019 Chain 1 - human_IL15(Q108E)-human_IL15Ralpha(Sushi)_ Fc(216)_IgG1_pI(-)_Isosteric_A_C220S/PVA_/S267K/L368D/K370S (19242)
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 265 - protein, 114 aa, Artificial Sequence; identical to SEQ ID NO: 205
  Description of Artificial Sequence: Synthetic polypeptide
  XENP024019 Human IL15

SEQ ID NO: 266 - protein, 231 aa, Artificial Sequence; identical to SEQ ID NO: 27
  Description of Artificial Sequence: Synthetic polypeptide
  Fc Chain of  XENP024019

SEQ ID NO: 267 - protein, 296 aa, Artificial Sequence; identical to SEQ ID NO: 61
  Description of Artificial Sequence: Synthetic polypeptide
  XENP024019 Chain 2 - human_IL15Ralpha(Sushi)_Fc(216)_IgG1_ C220S/PVA_/S267K/S364K/E357Q (16481)

SEQ ID NO: 268 - protein, 65 aa, Artificial Sequence; identical to SEQ ID NO: 4
  Description of Artificial Sequence: Synthetic polypeptide
  XENP024019 Human IL15Ralpha(Sushi)

SEQ ID NO: 269 - protein, 231 aa, Artificial Sequence; identical to SEQ ID NO: 26
  Description of Artificial Sequence: Synthetic polypeptide
  Fc Chain of  XENP024019

SEQ ID NO: 270 - protein, 350 aa, Artificial Sequence
  Description of Artificial Sequence: Synthetic polypeptide
  XENP024045 Chain 1 - human_IL15_D30N/E64Q/N65D_(GGGGS)1_ Fc(216)_IgG1_pI(-)_Isosteric_A_C220S/PVA_/S267K/L368D/ K370S
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 271 - protein, 114 aa, Artificial Sequence; identical to SEQ ID NO: 226
  Description of Artificial Sequence: Synthetic polypeptide
  XENP024045 Human IL15

SEQ ID NO: 272 - protein, 231 aa, Artificial Sequence; identical to SEQ ID NO: 27
  Description of Artificial Sequence: Synthetic polypeptide
  Fc Chain of  XENP024045

SEQ ID NO: 273 - protein, 301 aa, Artificial Sequence; identical to SEQ ID NO: 55
  Description of Artificial Sequence: Synthetic polypeptide
  XENP024045 Chain 2 - human_IL15Ralpha(Sushi)_(GGGGS)1_ Fc(216)_ IgG1_C220S/PVA_/S267K/S364K/E357Q

SEQ ID NO: 274 - protein, 65 aa, Artificial Sequence; identical to SEQ ID NO: 4
  Description of Artificial Sequence: Synthetic polypeptide
  XENP024045 Human IL15Ralpha(Sushi)

SEQ ID NO: 275 - protein, 231 aa, Artificial Sequence; identical to SEQ ID NO: 26
  Description of Artificial Sequence: Synthetic polypeptide
  Fc Chain of  XENP024045

SEQ ID NO: 276 - protein, 345 aa, Artificial Sequence
  Description of Artificial Sequence: Synthetic polypeptide
  XENP024051 Chain 1 - human_IL15_N1D/N65D-human_Fc(216)_IgG1_ pI(-)_Isosteric_A_C220S/PVA_/S267K/L368D/K370S
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 277 - protein, 114 aa, Artificial Sequence; identical to SEQ ID NO: 218
  Description of Artificial Sequence: Synthetic polypeptide
  XENP024051 Human IL15

SEQ ID NO: 278 - protein, 231 aa, Artificial Sequence; identical to SEQ ID NO: 27
  Description of Artificial Sequence: Synthetic polypeptide
  Fc Chain of  XENP024051

SEQ ID NO: 279 - protein, 296 aa, Artificial Sequence; identical to SEQ ID NO: 61
  Description of Artificial Sequence: Synthetic polypeptide
  XENP024051 Chain 2 - human_IL15Ralpha(Sushi)_ Fc(216)_IgG1_ C220S/PVA_/S267K/S364K/E357Q

SEQ ID NO: 280 - protein, 65 aa, Artificial Sequence; identical to SEQ ID NO: 4
  Description of Artificial Sequence: Synthetic polypeptide
  XENP024051 Human IL15Ralpha(Sushi)

SEQ ID NO: 281 - protein, 231 aa, Artificial Sequence; identical to SEQ ID NO: 26
  Description of Artificial Sequence: Synthetic polypeptide
  Fc Chain of  XENP024051

SEQ ID NO: 282 - protein, 345 aa, Artificial Sequence
  Description of Artificial Sequence: Synthetic polypeptide
  XENP024052 Chain 1 - human_IL15_N4D/N65D-human_ Fc(216)_IgG1_ pI(-)_Isosteric_A_C220S/PVA_/S267K/L368D/K370S
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 283 - protein, 114 aa, Artificial Sequence; identical to SEQ ID NO: 220
  Description of Artificial Sequence: Synthetic polypeptide
  XENP024052 Human IL15

SEQ ID NO: 284 - protein, 231 aa, Artificial Sequence; identical to SEQ ID NO: 27
  Description of Artificial Sequence: Synthetic polypeptide
  Fc Chain of  XENP024052

SEQ ID NO: 285 - protein, 296 aa, Artificial Sequence; identical to SEQ ID NO: 61
  Description of Artificial Sequence: Synthetic polypeptide
  XENP024052 Chain 2 - human_IL15Ralpha(Sushi)_Fc(216)_IgG1_ C220S/PVA_/S267K/S364K/E357Q

SEQ ID NO: 286 - protein, 65 aa, Artificial Sequence; identical to SEQ ID NO: 4
  Description of Artificial Sequence: Synthetic polypeptide
  XENP024052 Human IL15Ralpha(Sushi)

SEQ ID NO: 287 - protein, 231 aa, Artificial Sequence; identical to SEQ ID NO: 26
  Description of Artificial Sequence: Synthetic polypeptide
  Fc Chain of  XENP024052

SEQ ID NO: 288 - protein, 435 aa, Artificial Sequence
  Description of Artificial Sequence: Synthetic polypeptide
  XENP024015 Chain 1 - human_IL15Ralpha(sushi)_(GGGGS)5-human_ IL15(Q108E single-chain) _Fc(216)_IgG1_pI(-)_ Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 289 - protein, 65 aa, Artificial Sequence; identical to SEQ ID NO: 4
  Description of Artificial Sequence: Synthetic polypeptide
  XENP024015 Human IL15Ralpha(Sushi)

SEQ ID NO: 290 - protein, 114 aa, Artificial Sequence; identical to SEQ ID NO: 205
  Description of Artificial Sequence: Synthetic polypeptide
  XENP024015 Human IL15

SEQ ID NO: 291 - protein, 231 aa, Artificial Sequence; identical to SEQ ID NO: 27
  Description of Artificial Sequence: Synthetic polypeptide
  Fc Chain of XENP024015

SEQ ID NO: 292 - protein, 231 aa, Artificial Sequence; identical to SEQ ID NO: 26
  Description of Artificial Sequence: Synthetic polypeptide
  XENP024015 Chain 2 - empty_Fc(216)_IgG1_C220S/PVA_ /S267K/S364K/E357Q

SEQ ID NO: 293 - protein, 435 aa, Artificial Sequence
  Description of Artificial Sequence: Synthetic polypeptide
  XENP024050 Chain 1 - human_IL15Ralpha(sushi)_(GGGGS)5-human_ IL15_N4D/N65D_(single-chain)_Fc(216)_IgG1_pI(-)_ Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 294 - protein, 65 aa, Artificial Sequence; identical to SEQ ID NO: 4
  Description of Artificial Sequence: Synthetic polypeptide
  XENP024050 Human IL15Ralpha(Sushi)

SEQ ID NO: 295 - protein, 114 aa, Artificial Sequence; identical to SEQ ID NO: 220
  Description of Artificial Sequence: Synthetic polypeptide
  XENP024050 Human IL15

SEQ ID NO: 296 - protein, 231 aa, Artificial Sequence; identical to SEQ ID NO: 27
  Description of Artificial Sequence: Synthetic polypeptide
  Fc Chain of XENP024050

SEQ ID NO: 297 - protein, 231 aa, Artificial Sequence; identical to SEQ ID NO: 26
  Description of Artificial Sequence: Synthetic polypeptide
  XENP024050 Chain 2 - empty_ Fc(216)_IgG1_C220S/PVA_ /S267K/S364K/E357Q

SEQ ID NO: 298 - protein, 440 aa, Artificial Sequence
  Description of Artificial Sequence: Synthetic polypeptide
  XENP024475 Chain 1 - human_IL15Ralpha(sushi)_(GGGGS)6-human_ IL15(single-chain Q108E)_Fc(216)_IgG1_pI(-)_Isosteric_ A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 299 - protein, 65 aa, Artificial Sequence; identical to SEQ ID NO: 4
  Description of Artificial Sequence: Synthetic polypeptide
  XENP024475 Human IL15Ralpha(Sushi)

SEQ ID NO: 300 - protein, 114 aa, Artificial Sequence; identical to SEQ ID NO: 205
  Description of Artificial Sequence: Synthetic polypeptide
  XENP024475 Human IL15

SEQ ID NO: 301 - protein, 231 aa, Artificial Sequence; identical to SEQ ID NO: 27
  Description of Artificial Sequence: Synthetic polypeptide
  Fc Chain of XENP024475

SEQ ID NO: 302 - protein, 231 aa, Artificial Sequence; identical to SEQ ID NO: 26
  Description of Artificial Sequence: Synthetic polypeptide
  XENP024475 Chain 2 - empty_ Fc(216)_IgG1_C220S/PVA_ /S267K/S364K/E357Q

SEQ ID NO: 303 - protein, 440 aa, Artificial Sequence
  Description of Artificial Sequence: Synthetic polypeptide
  XENP024476 Chain 1 - human_IL15Ralpha(sushi)_(GGGGS)6-human_ IL15(single-chain N4D/N65D)_Fc(216)_IgG1_pI(-)_Isosteric_ A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 304 - protein, 65 aa, Artificial Sequence; identical to SEQ ID NO: 4
  Description of Artificial Sequence: Synthetic polypeptide
  XENP024476 Human IL15Ralpha(Sushi)

SEQ ID NO: 305 - protein, 114 aa, Artificial Sequence; identical to SEQ ID NO: 220
  Description of Artificial Sequence: Synthetic polypeptide
  XENP024476 Human IL15

SEQ ID NO: 306 - protein, 231 aa, Artificial Sequence; identical to SEQ ID NO: 27
  Description of Artificial Sequence: Synthetic polypeptide
  Fc Chain of XENP024476

SEQ ID NO: 307 - protein, 231 aa, Artificial Sequence; identical to SEQ ID NO: 26
  Description of Artificial Sequence: Synthetic polypeptide
  XENP024476 Chain 2 - empty_ Fc(216)_IgG1_C220S/PVA_ /S267K/S364K/E357Q

SEQ ID NO: 308 - protein, 445 aa, Artificial Sequence
  Description of Artificial Sequence: Synthetic polypeptide
  XENP024478 Chain 1 - human_IL15Ralpha(sushi)_(GGGGS)7-human_ IL15(single-chain Q108E)_Fc(216)_IgG1_pI(-)_Isosteric_ A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 309 - protein, 65 aa, Artificial Sequence; identical to SEQ ID NO: 4
  Description of Artificial Sequence: Synthetic polypeptide
  XENP024478 Human IL15Ralpha(Sushi)

SEQ ID NO: 310 - protein, 114 aa, Artificial Sequence; identical to SEQ ID NO: 205
  Description of Artificial Sequence: Synthetic polypeptide
  XENP024478 Human IL15

SEQ ID NO: 311 - protein, 231 aa, Artificial Sequence; identical to SEQ ID NO: 27
  Description of Artificial Sequence: Synthetic polypeptide
  Fc Chain of XENP024478

SEQ ID NO: 312 - protein, 231 aa, Artificial Sequence; identical to SEQ ID NO: 26
  Description of Artificial Sequence: Synthetic polypeptide
  XENP024478 Chain 2 - empty_ Fc(216)_IgG1_C220S/PVA_ /S267K/S364K/E357Q

SEQ ID NO: 313 - protein, 445 aa, Artificial Sequence
  Description of Artificial Sequence: Synthetic polypeptide
  XENP024479 Chain 1 - human_IL15Ralpha(sushi)_(GGGGS)7-human_ IL15(single-chain N4D/N65D)_Fc(216)_IgG1_pI(-)_Isosteric_ A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 314 - protein, 65 aa, Artificial Sequence; identical to SEQ ID NO: 4
  Description of Artificial Sequence: Synthetic polypeptide
  XENP024479 Human IL15Ralpha(Sushi)

SEQ ID NO: 315 - protein, 114 aa, Artificial Sequence; identical to SEQ ID NO: 220
  Description of Artificial Sequence: Synthetic polypeptide
  XENP024479 Human IL15

SEQ ID NO: 316 - protein, 231 aa, Artificial Sequence; identical to SEQ ID NO: 27
  Description of Artificial Sequence: Synthetic polypeptide
  Fc Chain of XENP024479

SEQ ID NO: 317 - protein, 231 aa, Artificial Sequence; identical to SEQ ID NO: 26
  Description of Artificial Sequence: Synthetic polypeptide
  XENP024479 Chain 2 - empty-Fc_Fc(216)_IgG1_C220S/PVA_ /S267K/S364K/E357Q

SEQ ID NO: 318 - protein, 440 aa, Artificial Sequence
  Description of Artificial Sequence: Synthetic polypeptide
  XENP024481 Chain 1 - human_IL15Ralpha(sushi)_(30AA_linker_ variant)-human_IL15(single-chain Q108E)_Fc(216)_IgG1_pI(- )_Isosteric_A_C220S/PVA_/S267K/L368D/K370S
ITCPPPMSVEHADIWVKSYSLYSRERYICNSGFKRKAGTSSLTECVLNKATNVAHWTTPSLKCIRDPALVHQRPAPPGGGGSGGGGSGGGGSGGGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 319 - protein, 65 aa, Artificial Sequence; identical to SEQ ID NO: 4
  Description of Artificial Sequence: Synthetic polypeptide
  XENP024481 Human IL15Ralpha(Sushi)

SEQ ID NO: 320 - protein, 114 aa, Artificial Sequence; identical to SEQ ID NO: 205
  Description of Artificial Sequence: Synthetic polypeptide
  XENP024481 Human IL15

SEQ ID NO: 321 - protein, 231 aa, Artificial Sequence; identical to SEQ ID NO: 27
  Description of Artificial Sequence: Synthetic polypeptide
  Fc Chain of XENP024481

SEQ ID NO: 322 - protein, 231 aa, Artificial Sequence; identical to SEQ ID NO: 26
  Description of Artificial Sequence: Synthetic polypeptide
  XENP024481 Chain 2 - empty_ Fc(216)_IgG1_C220S/PVA_ /S267K/S364K/E357Q

SEQ ID NO: 323 - protein, 296 aa, Artificial Sequence; identical to SEQ ID NO: 80
  Description of Artificial Sequence: Synthetic polypeptide
  XENP024349 Chain 1 - human_IL15Ralpha(Sushi)_ Isosteric_A_ C220S/PVA_/S267K/L368D/K370S

SEQ ID NO: 324 - protein, 65 aa, Artificial Sequence; identical to SEQ ID NO: 4
  Description of Artificial Sequence: Synthetic polypeptide
  XENP024349 Human IL15Ralpha(Sushi)

SEQ ID NO: 325 - protein, 231 aa, Artificial Sequence; identical to SEQ ID NO: 27
  Description of Artificial Sequence: Synthetic polypeptide
  Fc Chain of XENP024349

SEQ ID NO: 326 - protein, 231 aa, Artificial Sequence; identical to SEQ ID NO: 26
  Description of Artificial Sequence: Synthetic polypeptide
  XENP024349 Chain 2 - empty- Fc(216)_IgG1_C220S/PVA_ /S267K/S364K/E357Q

SEQ ID NO: 327 - protein, 114 aa, Artificial Sequence; identical to SEQ ID NO: 205
  Description of Artificial Sequence: Synthetic polypeptide
  XENP024349 Chain 3 - IL15_Q108E_(non-covalent)

SEQ ID NO: 328 - protein, 296 aa, Artificial Sequence; identical to SEQ ID NO: 80
  Description of Artificial Sequence: Synthetic polypeptide
  XENP024890 Chain 1 - IL-15_N4D/N65D

SEQ ID NO: 329 - protein, 65 aa, Artificial Sequence; identical to SEQ ID NO: 4
  Description of Artificial Sequence: Synthetic polypeptide
  XENP024890 IL15

SEQ ID NO: 330 - protein, 231 aa, Artificial Sequence; identical to SEQ ID NO: 27
  Description of Artificial Sequence: Synthetic polypeptide
  Fc Chain of XENP024890

SEQ ID NO: 331 - protein, 296 aa, Artificial Sequence; identical to SEQ ID NO: 80
  Description of Artificial Sequence: Synthetic polypeptide
  XENP024890 Chain 2 - human_IL15Ralpha(Sushi)_Fc(216)_IgG1_ pI(-)_Isosteric_A_C220S/PVA_/S267K/L368D/K370S

SEQ ID NO: 332 - protein, 65 aa, Artificial Sequence; identical to SEQ ID NO: 4
  Description of Artificial Sequence: Synthetic polypeptide
  XENP024890 Human IL15Ralpha(Sushi)

SEQ ID NO: 333 - protein, 231 aa, Artificial Sequence; identical to SEQ ID NO: 27
  Description of Artificial Sequence: Synthetic polypeptide
  Fc Chain of XENP024890

SEQ ID NO: 334 - protein, 231 aa, Artificial Sequence; identical to SEQ ID NO: 26
  Description of Artificial Sequence: Synthetic polypeptide
  XENP024890 Chain 3 - empty_Fc(216)_ IgG1_PVA_ /S267K/S364K/E357Q

SEQ ID NO: 335 - protein, 114 aa, Artificial Sequence; identical to SEQ ID NO: 226
  Description of Artificial Sequence: Synthetic polypeptide
  XENP25138 Chain 1 - IL15_D30N/E64Q/N65D

SEQ ID NO: 336 - protein, 296 aa, Artificial Sequence; identical to SEQ ID NO: 80
  Description of Artificial Sequence: Synthetic polypeptide
  XENP25138 Chain 2 - human_IL15Ralpha(Sushi)_Fc(216)_IgG1_pI(-)_ Isosteric_A_C220S/PVA_/S267K/L368D/K370S

SEQ ID NO: 337 - protein, 65 aa, Artificial Sequence; identical to SEQ ID NO: 4
  Description of Artificial Sequence: Synthetic polypeptide
  XENP25138 Human IL15Ralpha(Sushi)

SEQ ID NO: 338 - protein, 231 aa, Artificial Sequence; identical to SEQ ID NO: 27
  Description of Artificial Sequence: Synthetic polypeptide
  Fc Chain of XENP25138

SEQ ID NO: 339 - protein, 231 aa, Artificial Sequence; identical to SEQ ID NO: 26
  Description of Artificial Sequence: Synthetic polypeptide
  XENP25138 Chain 3 - empty_Fc(216)_ IgG1_PVA_/S267K/S364K/E357Q

SEQ ID NO: 340 - protein, 114 aa, Artificial Sequence; identical to SEQ ID NO: 204
  Description of Artificial Sequence: Synthetic polypeptide
  XENP022801 Chain 1 - human_IL15_N65D(non-covalent) (17672)

SEQ ID NO: 341 - protein, 65 aa, Artificial Sequence; identical to SEQ ID NO: 4
  Description of Artificial Sequence: Synthetic polypeptide
  XENP022801 Chain 2 - human_IL15Ralpha(Sushi) (17033)

SEQ ID NO: 342 - protein, 114 aa, Artificial Sequence; identical to SEQ ID NO: 205
  Description of Artificial Sequence: Synthetic polypeptide
  XENP022802 Chain 1 - human_IL15_Q108E(non-covalent) (17673)

SEQ ID NO: 343 - protein, 65 aa, Artificial Sequence; identical to SEQ ID NO: 4
  Description of Artificial Sequence: Synthetic polypeptide
  XENP022802 Chain 2 - human_IL15Ralpha(Sushi) (17033)

SEQ ID NO: 344 - protein, 296 aa, Artificial Sequence; identical to SEQ ID NO: 84
  Description of Artificial Sequence: Synthetic polypeptide
  XENP024342 Chain 1 - human_IL15Ralpha(Sushi) _Fc(216)_IgG1_ C220S/PVA_/S267K

SEQ ID NO: 345 - protein, 65 aa, Artificial Sequence; identical to SEQ ID NO: 4
  Description of Artificial Sequence: Synthetic polypeptide
  XENP024342 Human IL15Ralpha(Sushi)

SEQ ID NO: 346 - protein, 231 aa, Artificial Sequence; identical to SEQ ID NO: 48
  Description of Artificial Sequence: Synthetic polypeptide
  Fc Chain of XENP024342

SEQ ID NO: 347 - protein, 114 aa, Artificial Sequence; identical to SEQ ID NO: 205
  Description of Artificial Sequence: Synthetic polypeptide
  XENP024342 Chain 2 -human_IL15(non-covalent  Q108E)

SEQ ID NO: 348 - protein, 231 aa, Artificial Sequence; identical to SEQ ID NO: 27
  Description of Artificial Sequence: Synthetic polypeptide
  XENP023472 Chain 1 - empty_ Fc(216)_IgG1_pI(-)_Isosteric_A_ C220S/PVA_/S267K/L368D/K370S

SEQ ID NO: 349 - protein, 114 aa, Artificial Sequence
  Description of Artificial Sequence: Synthetic polypeptide
  XENP023472 Chain 2 - IL15_N65D/E87C
NWVNVISDLKKIEDLIQSMHIDATLYTESDVHPSCKVTAMKCFLLELQVISLESGDASIHDTVEDLIILANNSLSSNGNVTESGCKCCEELEEKNIKEFLQSFVHIVQMFINTS

SEQ ID NO: 350 - protein, 298 aa, Artificial Sequence
  Description of Artificial Sequence: Synthetic polypeptide
  XENP023472 Chain 3 - IL15Ralpha(Sushi-D96/C97)_Fc(216)_IgG1_ C220S/PVA_/S267K/S364K/E357Q
ITCPPPMSVEHADIWVKSYSLYSRERYICNSGFKRKAGTSSLTECVLNKATNVAHWTTPSLKCIRDCEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 351 - protein, 67 aa, Artificial Sequence; identical to SEQ ID NO: 113
  Description of Artificial Sequence: Synthetic polypeptide
  XENP023472 IL15Ralpha(Sushi)

SEQ ID NO: 352 - protein, 231 aa, Artificial Sequence; identical to SEQ ID NO: 26
  Description of Artificial Sequence: Synthetic polypeptide
  Fc Chain of XENP023472

SEQ ID NO: 353 - protein, 231 aa, Artificial Sequence; identical to SEQ ID NO: 27
  Description of Artificial Sequence: Synthetic polypeptide
  XENP023473 Chain 1 - empty_ Fc(216)_IgG1_pI(-)_Isosteric_A_ C220S/PVA_/S267K/L368D/K370S

SEQ ID NO: 354 - protein, 114 aa, Artificial Sequence
  Description of Artificial Sequence: Synthetic polypeptide
  XENP023473 Chain 2 - IL15_N65D/L52C
NWVNVISDLKKIEDLIQSMHIDATLYTESDVHPSCKVTAMKCFLLELQVISCESGDASIHDTVEDLIILANNSLSSNGNVTESGCKECEELEEKNIKEFLQSFVHIVQMFINTS

SEQ ID NO: 355 - protein, 296 aa, Artificial Sequence
  Description of Artificial Sequence: Synthetic polypeptide
  XENP023473 Chain 3 - IL15Ralpha(Sushi-S40C)_Fc(216)_IgG1_ C220S/PVA_/S267K/S364K/E357Q
ITCPPPMSVEHADIWVKSYSLYSRERYICNSGFKRKAGTCSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 356 - protein, 65 aa, Artificial Sequence; identical to SEQ ID NO: 116
  Description of Artificial Sequence: Synthetic polypeptide
  XENP023473 IL15Ralpha(Sushi)

SEQ ID NO: 357 - protein, 231 aa, Artificial Sequence; identical to SEQ ID NO: 26
  Description of Artificial Sequence: Synthetic polypeptide
  Fc Chain of XENP023473

SEQ ID NO: 358 - protein, 350 aa, Artificial Sequence
  Description of Artificial Sequence: Synthetic polypeptide
  XENP023343 Chain 1 - human_IL15_N65D_(GGGGS)1_Fc(216)_IgG1_ pI(-)_Isosteric_A_C220S/PVA_/S267K/L368D/K370S/M428L/N434S (18295)
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 359 - protein, 114 aa, Artificial Sequence; identical to SEQ ID NO: 204
  Description of Artificial Sequence: Synthetic polypeptide
  XENP023343 Human IL15

SEQ ID NO: 360 - protein, 231 aa, Artificial Sequence; identical to SEQ ID NO: 47
  Description of Artificial Sequence: Synthetic polypeptide
  Fc Chain of XENP023343

SEQ ID NO: 361 - protein, 301 aa, Artificial Sequence
  Description of Artificial Sequence: Synthetic polypeptide
  XENP023343 Chain 2 - human_IL15Ralpha(Sushi)_(GGGGS)1_Fc(216)_ IgG1_C220S/PVA_/S267K/S364K/E357Q/M428L/N434S (17761)
ITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 362 - protein, 65 aa, Artificial Sequence; identical to SEQ ID NO: 4
  Description of Artificial Sequence: Synthetic polypeptide
  XENP023343 Human IL15Ralpha(Sushi)

SEQ ID NO: 363 - protein, 231 aa, Artificial Sequence; identical to SEQ ID NO: 46
  Description of Artificial Sequence: Synthetic polypeptide
  Fc Chain of XENP023343

SEQ ID NO: 364 - protein, 350 aa, Artificial Sequence
  Description of Artificial Sequence: Synthetic polypeptide
  XENP023504 Chain 1 - human_IL15_Q108E_(GGGGS)1_Fc(216)_IgG1_ pI(-)_Isosteric_A_C220S/PVA_/S267K/L368D/K370S/M428L/N434S
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 365 - protein, 114 aa, Artificial Sequence; identical to SEQ ID NO: 205
  Description of Artificial Sequence: Synthetic polypeptide
  XENP023504 Human IL15

SEQ ID NO: 366 - protein, 231 aa, Artificial Sequence; identical to SEQ ID NO: 47
  Description of Artificial Sequence: Synthetic polypeptide
  Fc Chain of XENP023504

SEQ ID NO: 367 - protein, 301 aa, Artificial Sequence; identical to SEQ ID NO: 361
  Description of Artificial Sequence: Synthetic polypeptide
  XENP023504 Chain 2 - human_IL15Ralpha(Sushi)_(GGGGS)1_ Fc(216)_ IgG1_C220S/PVA_/S267K/S364K/E357Q/M428L/N434S

SEQ ID NO: 368 - protein, 65 aa, Artificial Sequence; identical to SEQ ID NO: 4
  Description of Artificial Sequence: Synthetic polypeptide
  XENP023504 Human IL15Ralpha(Sushi)

SEQ ID NO: 369 - protein, 231 aa, Artificial Sequence; identical to SEQ ID NO: 46
  Description of Artificial Sequence: Synthetic polypeptide
  Fc Chain of XENP023504

SEQ ID NO: 370 - protein, 350 aa, Artificial Sequence
  Description of Artificial Sequence: Synthetic polypeptide
  XENP024113 Chain 1 - human_IL15_N4D/N65D_(GGGGS)1_Fc(216)_IgG1_ pI(-)_Isosteric_A_C220S/PVA_/S267K/L368D/K370S/M428L/N434S
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 371 - protein, 114 aa, Artificial Sequence; identical to SEQ ID NO: 220
  Description of Artificial Sequence: Synthetic polypeptide
  XENP024113 Human IL15

SEQ ID NO: 372 - protein, 231 aa, Artificial Sequence; identical to SEQ ID NO: 47
  Description of Artificial Sequence: Synthetic polypeptide
  Fc Chain of XENP024113

SEQ ID NO: 373 - protein, 301 aa, Artificial Sequence; identical to SEQ ID NO: 361
  Description of Artificial Sequence: Synthetic polypeptide
  XENP024113 Chain 2 -human_IL15Ralpha(Sushi)_(GGGGS)1_Fc(216)_ IgG1_C220S/PVA_/S267K/S364K/E357Q/M428L/N434S

SEQ ID NO: 374 - protein, 65 aa, Artificial Sequence; identical to SEQ ID NO: 4
  Description of Artificial Sequence: Synthetic polypeptide
  XENP024113 Human IL15Ralpha(Sushi)

SEQ ID NO: 375 - protein, 231 aa, Artificial Sequence; identical to SEQ ID NO: 46
  Description of Artificial Sequence: Synthetic polypeptide
  Fc Chain of XENP024113

SEQ ID NO: 376 - protein, 345 aa, Artificial Sequence
  Description of Artificial Sequence: Synthetic polypeptide
  XENP024301 Chain 1 - human_IL15_N4D/N65D_Fc(216)_IgG1_pI(-)_ Isosteric_A_C220S/PVA_/S267K/L368D/K370S/M428L/N434S
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 377 - protein, 114 aa, Artificial Sequence; identical to SEQ ID NO: 220
  Description of Artificial Sequence: Synthetic polypeptide
  XENP024301 Human IL15

SEQ ID NO: 378 - protein, 231 aa, Artificial Sequence; identical to SEQ ID NO: 47
  Description of Artificial Sequence: Synthetic polypeptide
  Fc Chain of XENP024301

SEQ ID NO: 379 - protein, 296 aa, Artificial Sequence
  Description of Artificial Sequence: Synthetic polypeptide
  XENP024301 Chain 2 - human_IL15Ralpha(Sushi)_ Fc(216)_IgG1_ C220S/PVA_/S267K/S364K/E357Q/M428L/N434S
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 380 - protein, 65 aa, Artificial Sequence; identical to SEQ ID NO: 4
  Description of Artificial Sequence: Synthetic polypeptide
  XENP024301 Human IL15Ralpha(Sushi)

SEQ ID NO: 381 - protein, 231 aa, Artificial Sequence; identical to SEQ ID NO: 46
  Description of Artificial Sequence: Synthetic polypeptide
  Fc Chain of XENP024301

SEQ ID NO: 382 - protein, 350 aa, Artificial Sequence
  Description of Artificial Sequence: Synthetic polypeptide
  XENP024306 Chain 1 - human_IL15_D30N/E64Q/N65D_(GGGGS)1_ Fc(216)_IgG1_pI(-)_Isosteric_A_C220S/PVA_/S267K/L368D/ K370S/M428L/N434S
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 383 - protein, 114 aa, Artificial Sequence; identical to SEQ ID NO: 226
  Description of Artificial Sequence: Synthetic polypeptide
  XENP024306 Human IL15

SEQ ID NO: 384 - protein, 231 aa, Artificial Sequence; identical to SEQ ID NO: 47
  Description of Artificial Sequence: Synthetic polypeptide
  Fc Chain of XENP024306

SEQ ID NO: 385 - protein, 301 aa, Artificial Sequence; identical to SEQ ID NO: 361
  Description of Artificial Sequence: Synthetic polypeptide
  XENP024306 Chain 2 - human_IL15Ralpha(Sushi)_(GGGGS)1_Fc(216)_ IgG1_C220S/PVA_/S267K/S364K/E357Q/M428L/N434S

SEQ ID NO: 386 - protein, 65 aa, Artificial Sequence; identical to SEQ ID NO: 4
  Description of Artificial Sequence: Synthetic polypeptide
  XENP024306 Human IL15Ralpha(Sushi)

SEQ ID NO: 387 - protein, 231 aa, Artificial Sequence; identical to SEQ ID NO: 46
  Description of Artificial Sequence: Synthetic polypeptide
  Fc Chain of XENP024306

SEQ ID NO: 388 - protein, 345 aa, Artificial Sequence
  Description of Artificial Sequence: Synthetic polypeptide
  XENP024341 Chain 1 - human_IL15_N1D/N65D-human_Fc(216)_IgG1_ pI(-)_Isosteric_A_C220S/PVA_/S267K/L368D/K370S/M428L/N434S
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 389 - protein, 114 aa, Artificial Sequence; identical to SEQ ID NO: 218
  Description of Artificial Sequence: Synthetic polypeptide
  XENP024341 Human IL15

SEQ ID NO: 390 - protein, 231 aa, Artificial Sequence; identical to SEQ ID NO: 47
  Description of Artificial Sequence: Synthetic polypeptide
  Fc Chain of XENP024341

SEQ ID NO: 391 - protein, 296 aa, Artificial Sequence; identical to SEQ ID NO: 379
  Description of Artificial Sequence: Synthetic polypeptide
  XENP024341 Chain 2 - human_IL15Ralpha(Sushi)_Fc(216)_IgG1_ C220S/PVA_/S267K/S364K/E357Q/M428L/N434S

SEQ ID NO: 392 - protein, 65 aa, Artificial Sequence; identical to SEQ ID NO: 4
  Description of Artificial Sequence: Synthetic polypeptide
  XENP024341 Human IL15Ralpha(Sushi)

SEQ ID NO: 393 - protein, 231 aa, Artificial Sequence; identical to SEQ ID NO: 46
  Description of Artificial Sequence: Synthetic polypeptide
  Fc Chain of XENP024341

SEQ ID NO: 394 - protein, 435 aa, Artificial Sequence
  Description of Artificial Sequence: Synthetic polypeptide
  XENP025938 Chain 1 - human_IL15Ralpha(sushi)_(GGGGS)5-human_ IL15_N4D/N65D_(single-chain)-_Fc(216)_IgG1_pI(-)_Isosteric_ A_C220S/PVA_/S267K/L368D/K370S/M428L/N434S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 395 - protein, 65 aa, Artificial Sequence; identical to SEQ ID NO: 4
  Description of Artificial Sequence: Synthetic polypeptide
  XENP025938 Human IL15Ralpha(Sushi)

SEQ ID NO: 396 - protein, 114 aa, Artificial Sequence; identical to SEQ ID NO: 220
  Description of Artificial Sequence: Synthetic polypeptide
  XENP025938 Human IL15

SEQ ID NO: 397 - protein, 231 aa, Artificial Sequence; identical to SEQ ID NO: 47
  Description of Artificial Sequence: Synthetic polypeptide
  Fc Chain of XENP025938

SEQ ID NO: 398 - protein, 231 aa, Artificial Sequence; identical to SEQ ID NO: 46
  Description of Artificial Sequence: Synthetic polypeptide
  XENP025938 Chain 2 - empty_Fc(216)_IgG1_C220S/PVA_ /S267K/S364K/E357Q/M428L/N434S

SEQ ID NO: 399 - protein, 114 aa, Artificial Sequence; identical to SEQ ID NO: 205
  Description of Artificial Sequence: Synthetic polypeptide
  XENP024383 Chain 1 - IL15_Q108E

SEQ ID NO: 400 - protein, 296 aa, Artificial Sequence
  Description of Artificial Sequence: Synthetic polypeptide
  XENP024383 Chain 2 - human_IL15Ralpha(Sushi)_Fc(216)_IgG1_ pI(-)_Isosteric_A_C220S/PVA_/S267K/L368D/K370S/M428L/N434S
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 401 - protein, 65 aa, Artificial Sequence; identical to SEQ ID NO: 4
  Description of Artificial Sequence: Synthetic polypeptide
  XENP024383 Human IL15Ralpha(Sushi)

SEQ ID NO: 402 - protein, 231 aa, Artificial Sequence; identical to SEQ ID NO: 47
  Description of Artificial Sequence: Synthetic polypeptide
  Fc Chain of XENP024383

SEQ ID NO: 403 - protein, 231 aa, Artificial Sequence; identical to SEQ ID NO: 46
  Description of Artificial Sequence: Synthetic polypeptide
  XENP024383 Chain 3 - empty_ Fc(216)_IgG1_C220S/PVA_ /S267K/S364K/E357Q/M428L/N434S

SEQ ID NO: 404 - protein, 296 aa, Artificial Sequence
  Description of Artificial Sequence: Synthetic polypeptide
  XENP024346 Chain 1 - human_IL15Ralpha(Sushi)_Fc(216)_IgG1_ C220S/PVA_/S267K/M428L/N434S
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 405 - protein, 65 aa, Artificial Sequence; identical to SEQ ID NO: 4
  Description of Artificial Sequence: Synthetic polypeptide
  XENP024346 Human IL15Ralpha(Sushi)

SEQ ID NO: 406 - protein, 231 aa, Artificial Sequence
  Description of Artificial Sequence: Synthetic polypeptide
  Fc Chain of XENP024346
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 407 - protein, 114 aa, Artificial Sequence; identical to SEQ ID NO: 205
  Description of Artificial Sequence: Synthetic polypeptide
  XENP024346 Chain 2 - human_IL15(non-covalent  Q108E)

SEQ ID NO: 408 - protein, 114 aa, Artificial Sequence; identical to SEQ ID NO: 220
  Description of Artificial Sequence: Synthetic polypeptide
  XENP024351 Chain 1 - IL15(N4D/N65D)

SEQ ID NO: 409 - protein, 296 aa, Artificial Sequence; identical to SEQ ID NO: 404
  Description of Artificial Sequence: Synthetic polypeptide
  XENP024351 Chain 2 - human_IL15Ralpha(Sushi)_Fc(216)_IgG1_ C220S/PVA_/S267K/M428L/N434S

SEQ ID NO: 410 - protein, 65 aa, Artificial Sequence; identical to SEQ ID NO: 4
  Description of Artificial Sequence: Synthetic polypeptide
  XENP024351 Human IL15Ralpha(Sushi)

SEQ ID NO: 411 - protein, 231 aa, Artificial Sequence; identical to SEQ ID NO: 406
  Description of Artificial Sequence: Synthetic polypeptide
  Fc Chain of XENP024351

SEQ ID NO: 412 - protein, 350 aa, Artificial Sequence; identical to SEQ ID NO: 52
  Description of Artificial Sequence: Synthetic polypeptide
  XENP20818 Chain 1 - human_IL15_(GGGGS)1_Fc(216)_IgG1_pI(-)_ Isosteric_A_C220S/PVA_/S267K/L368D/K370S (15902)

SEQ ID NO: 413 - protein, 114 aa, Artificial Sequence; identical to SEQ ID NO: 2
  Description of Artificial Sequence: Synthetic polypeptide
  XENP20818 Human IL15

SEQ ID NO: 414 - protein, 231 aa, Artificial Sequence; identical to SEQ ID NO: 27
  Description of Artificial Sequence: Synthetic polypeptide
  Fc Chain of XENP20818

SEQ ID NO: 415 - protein, 301 aa, Artificial Sequence; identical to SEQ ID NO: 55
  Description of Artificial Sequence: Synthetic polypeptide
  XENP20818 Chain 2 - human_IL15Ralpha(Sushi)_(GGGGS)1_Fc(216)_ IgG1_C220S/PVA_/S267K/S364K/E357Q (15908)

SEQ ID NO: 416 - protein, 65 aa, Artificial Sequence; identical to SEQ ID NO: 4
  Description of Artificial Sequence: Synthetic polypeptide
  XENP20818 Human IL15Ralpha(Sushi)

SEQ ID NO: 417 - protein, 231 aa, Artificial Sequence; identical to SEQ ID NO: 26
  Description of Artificial Sequence: Synthetic polypeptide
  Fc Chain of XENP20818

SEQ ID NO: 418 - protein, 350 aa, Artificial Sequence; identical to SEQ ID NO: 52
  Description of Artificial Sequence: Synthetic polypeptide
  XENP20819 Chain 1 - human_IL15_(GGGGS)1_Fc(216)_IgG1_pI(-)_ Isosteric_A_C220S/PVA_/S267K/L368D/K370S (15902)

SEQ ID NO: 419 - protein, 114 aa, Artificial Sequence; identical to SEQ ID NO: 2
  Description of Artificial Sequence: Synthetic polypeptide
  XENP20819 Human IL15

SEQ ID NO: 420 - protein, 231 aa, Artificial Sequence; identical to SEQ ID NO: 27
  Description of Artificial Sequence: Synthetic polypeptide
  Fc Chain of XENP20819

SEQ ID NO: 421 - protein, 316 aa, Artificial Sequence
  Description of Artificial Sequence: Synthetic polypeptide
  XENP20819 Chain 2 - human_IL15Ralpha(Sushi)_(GGGGS)4_Fc(216)_ IgG1_C220S/PVA_/S267K/S364K/E357Q (15909)
ITCPPPMSVEHADIWVKSYSLYSRERYICNSGFKRKAGTSSLTECVLNKATNVAHWTTPSLKCIRGGGGSGGGGSGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 422 - protein, 65 aa, Artificial Sequence; identical to SEQ ID NO: 4
  Description of Artificial Sequence: Synthetic polypeptide
  XENP20819 Human IL15Ralpha(Sushi)

SEQ ID NO: 423 - protein, 231 aa, Artificial Sequence; identical to SEQ ID NO: 26
  Description of Artificial Sequence: Synthetic polypeptide
  Fc Chain of XENP20819

SEQ ID NO: 424 - protein, 345 aa, Artificial Sequence; identical to SEQ ID NO: 58
  Description of Artificial Sequence: Synthetic polypeptide
  XENP21471 Chain 1 - human_IL15-Fc(216)_IgG1_pI(-)_Isosteric_A_ C220S/PVA_/S267K/L368D/K370S (16479)

SEQ ID NO: 425 - protein, 114 aa, Artificial Sequence; identical to SEQ ID NO: 2
  Description of Artificial Sequence: Synthetic polypeptide
  XENP21471 Human IL15

SEQ ID NO: 426 - protein, 231 aa, Artificial Sequence; identical to SEQ ID NO: 27
  Description of Artificial Sequence: Synthetic polypeptide
  Fc Chain of XENP21471

SEQ ID NO: 427 - protein, 301 aa, Artificial Sequence; identical to SEQ ID NO: 55
  Description of Artificial Sequence: Synthetic polypeptide
  XENP21471 Chain 2 - human_IL15Ralpha(Sushi)_(GGGGS)1_Fc(216)_ IgG1_C220S/PVA_/S267K/S364K/E357Q (15908)

SEQ ID NO: 428 - protein, 65 aa, Artificial Sequence; identical to SEQ ID NO: 4
  Description of Artificial Sequence: Synthetic polypeptide
  XENP21471 Human IL15Ralpha(Sushi)

SEQ ID NO: 429 - protein, 231 aa, Artificial Sequence; identical to SEQ ID NO: 26
  Description of Artificial Sequence: Synthetic polypeptide
  Fc Chain of XENP21471

SEQ ID NO: 430 - protein, 350 aa, Artificial Sequence; identical to SEQ ID NO: 52
  Description of Artificial Sequence: Synthetic polypeptide
  XENP21472 Chain 1 - human_IL15_(GGGGS)1_Fc(216)_IgG1_pI(-)_ Isosteric_A_C220S/PVA_/S267K/L368D/K370S (15902)

SEQ ID NO: 431 - protein, 114 aa, Artificial Sequence; identical to SEQ ID NO: 2
  Description of Artificial Sequence: Synthetic polypeptide
  XENP21472 Human IL15

SEQ ID NO: 432 - protein, 231 aa, Artificial Sequence; identical to SEQ ID NO: 27
  Description of Artificial Sequence: Synthetic polypeptide
  Fc Chain of XENP21472

SEQ ID NO: 433 - protein, 296 aa, Artificial Sequence; identical to SEQ ID NO: 61
  Description of Artificial Sequence: Synthetic polypeptide
  XENP21472 Chain 2 - human_IL15Ralpha(Sushi)-Fc(216)_IgG1_ C220S/PVA_/S267K/S364K/E357Q (16481)

SEQ ID NO: 434 - protein, 65 aa, Artificial Sequence; identical to SEQ ID NO: 4
  Description of Artificial Sequence: Synthetic polypeptide
  XENP21472 Human IL15Ralpha(Sushi)

SEQ ID NO: 435 - protein, 231 aa, Artificial Sequence; identical to SEQ ID NO: 26
  Description of Artificial Sequence: Synthetic polypeptide
  Fc Chain of XENP21472

SEQ ID NO: 436 - protein, 350 aa, Artificial Sequence; identical to SEQ ID NO: 52
  Description of Artificial Sequence: Synthetic polypeptide
  XENP21473 Chain 1 - human_IL15_(GGGGS)1_Fc(216)_IgG1_pI(-)_ Isosteric_A_C220S/PVA_/S267K/L368D/K370S (15902)

SEQ ID NO: 437 - protein, 114 aa, Artificial Sequence; identical to SEQ ID NO: 2
  Description of Artificial Sequence: Synthetic polypeptide
  XENP21473 Human Il15

SEQ ID NO: 438 - protein, 231 aa, Artificial Sequence; identical to SEQ ID NO: 27
  Description of Artificial Sequence: Synthetic polypeptide
  Fc Chain of XENP21473

SEQ ID NO: 439 - protein, 311 aa, Artificial Sequence
  Description of Artificial Sequence: Synthetic polypeptide
  XENP21473 Chain 2 - human_IL15Ralpha(Sushi)_(GGGGS)3_Fc(216)_ IgG1_C220S/PVA_/S267K/S364K/E357Q (16483)
ITCPPPMSVEHADIWVKSYSLYSRERYICNSGFKRKAGTSSLTECVLNKATNVAHWTTPSLKCIRGGGGSGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 440 - protein, 65 aa, Artificial Sequence; identical to SEQ ID NO: 4
  Description of Artificial Sequence: Synthetic polypeptide
  XENP21473 Human IL15Ralpha(Sushi)

SEQ ID NO: 441 - protein, 231 aa, Artificial Sequence; identical to SEQ ID NO: 26
  Description of Artificial Sequence: Synthetic polypeptide
  Fc Chain of XENP21473

SEQ ID NO: 442 - protein, 345 aa, Artificial Sequence; identical to SEQ ID NO: 58
  Description of Artificial Sequence: Synthetic polypeptide
  XENP21474 Chain 1 - human_IL15-Fc(216)_IgG1_pI(-)_Isosteric_A_ C220S/PVA_/S267K/L368D/K370S (16479)

SEQ ID NO: 443 - protein, 114 aa, Artificial Sequence; identical to SEQ ID NO: 2
  Description of Artificial Sequence: Synthetic polypeptide
  XENP21474 Human IL15

SEQ ID NO: 444 - protein, 231 aa, Artificial Sequence; identical to SEQ ID NO: 27
  Description of Artificial Sequence: Synthetic polypeptide
  Fc Chain of XENP21474

SEQ ID NO: 445 - protein, 316 aa, Artificial Sequence; identical to SEQ ID NO: 421
  Description of Artificial Sequence: Synthetic polypeptide
  XENP21474 Chain 2 - human_IL15Ralpha(Sushi)_(GGGGS)4_Fc(216)_ IgG1_C220S/PVA_/S267K/S364K/E357Q (15909)

SEQ ID NO: 446 - protein, 65 aa, Artificial Sequence; identical to SEQ ID NO: 4
  Description of Artificial Sequence: Synthetic polypeptide
  XENP21474 Human IL15Ralpha(Sushi)

SEQ ID NO: 447 - protein, 231 aa, Artificial Sequence; identical to SEQ ID NO: 26
  Description of Artificial Sequence: Synthetic polypeptide
  Fc Chain of XENP21474

SEQ ID NO: 448 - protein, 345 aa, Artificial Sequence; identical to SEQ ID NO: 58
  Description of Artificial Sequence: Synthetic polypeptide
  XENP21475 Chain 1 - human_IL15-Fc(216)_IgG1_pI(-)_Isosteric_A_ C220S/PVA_/S267K/L368D/K370S (16479)

SEQ ID NO: 449 - protein, 114 aa, Artificial Sequence; identical to SEQ ID NO: 2
  Description of Artificial Sequence: Synthetic polypeptide
  XENP21475 Human IL15

SEQ ID NO: 450 - protein, 231 aa, Artificial Sequence; identical to SEQ ID NO: 27
  Description of Artificial Sequence: Synthetic polypeptide
  Fc Chain of XENP21475

SEQ ID NO: 451 - protein, 296 aa, Artificial Sequence; identical to SEQ ID NO: 61
  Description of Artificial Sequence: Synthetic polypeptide
  XENP21475 Chain 2 - human_IL15Ralpha(Sushi)-Fc(216)_IgG1_ C220S/PVA_/S267K/S364K/E357Q (16481)

SEQ ID NO: 452 - protein, 65 aa, Artificial Sequence; identical to SEQ ID NO: 4
  Description of Artificial Sequence: Synthetic polypeptide
  XENP21475 Human IL15Ralpha(Sushi)

SEQ ID NO: 453 - protein, 231 aa, Artificial Sequence; identical to SEQ ID NO: 26
  Description of Artificial Sequence: Synthetic polypeptide
  Fc Chain of XENP21475

SEQ ID NO: 454 - protein, 355 aa, Artificial Sequence
  Description of Artificial Sequence: Synthetic polypeptide
  XENP21476 Chain 1 - human_IL15_(GGGGS)2_Fc(216)_IgG1_pI(-)_ Isosteric_A_C220S/PVA_/S267K/L368D/K370S (16480)
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 455 - protein, 114 aa, Artificial Sequence; identical to SEQ ID NO: 2
  Description of Artificial Sequence: Synthetic polypeptide
  XENP21476 Human IL15

SEQ ID NO: 456 - protein, 231 aa, Artificial Sequence; identical to SEQ ID NO: 27
  Description of Artificial Sequence: Synthetic polypeptide
  Fc Chain of XENP21476

SEQ ID NO: 457 - protein, 306 aa, Artificial Sequence
  Description of Artificial Sequence: Synthetic polypeptide
  XENP21476 Chain 2 - human_IL15Ralpha(Sushi)_(GGGGS)2_Fc(216)_ IgG1_C220S/PVA_/S267K/S364K/E357Q (16482)
ITCPPPMSVEHADIWVKSYSLYSRERYICNSGFKRKAGTSSLTECVLNKATNVAHWTTPSLKCIRGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 458 - protein, 65 aa, Artificial Sequence; identical to SEQ ID NO: 4
  Description of Artificial Sequence: Synthetic polypeptide
  XENP21476 Human IL15Ralpha(Sushi)

SEQ ID NO: 459 - protein, 231 aa, Artificial Sequence; identical to SEQ ID NO: 26
  Description of Artificial Sequence: Synthetic polypeptide
  Fc Chain of XENP21476

SEQ ID NO: 460 - protein, 355 aa, Artificial Sequence; identical to SEQ ID NO: 454
  Description of Artificial Sequence: Synthetic polypeptide
  XENP21477 Chain 1 - human_IL15_(GGGGS)2_Fc(216)_IgG1_pI(-)_ Isosteric_A_C220S/PVA_/S267K/L368D/K370S (16480)

SEQ ID NO: 461 - protein, 114 aa, Artificial Sequence; identical to SEQ ID NO: 2
  Description of Artificial Sequence: Synthetic polypeptide
  XENP21477 Human IL15

SEQ ID NO: 462 - protein, 231 aa, Artificial Sequence; identical to SEQ ID NO: 27
  Description of Artificial Sequence: Synthetic polypeptide
  Fc Chain of XENP21477

SEQ ID NO: 463 - protein, 316 aa, Artificial Sequence; identical to SEQ ID NO: 421
  Description of Artificial Sequence: Synthetic polypeptide
  XENP21477 Chain 2 - human_IL15Ralpha(Sushi)_(GGGGS)4_Fc(216)_ IgG1_C220S/PVA_/S267K/S364K/E357Q (15909)

SEQ ID NO: 464 - protein, 65 aa, Artificial Sequence; identical to SEQ ID NO: 4
  Description of Artificial Sequence: Synthetic polypeptide
  XENP21477 Human IL15Ralpha(Sushi)

SEQ ID NO: 465 - protein, 231 aa, Artificial Sequence; identical to SEQ ID NO: 26
  Description of Artificial Sequence: Synthetic polypeptide
  Fc Chain of XENP21477

SEQ ID NO: 466 - protein, 440 aa, Artificial Sequence; identical to SEQ ID NO: 64
  Description of Artificial Sequence: Synthetic polypeptide
  XENP21478 Chain 1 - human_IL15Ralpha(sushi)_(GGGGS)6-human_ IL15-Fc(216)_IgG1_pI(-)_Isosteric_A_C220S/PVA_/S267K/L368D/ K370S (16478)

SEQ ID NO: 467 - protein, 65 aa, Artificial Sequence; identical to SEQ ID NO: 4
  Description of Artificial Sequence: Synthetic polypeptide
  XENP21478 Human IL15Ralpha(Sushi)

SEQ ID NO: 468 - protein, 114 aa, Artificial Sequence; identical to SEQ ID NO: 2
  Description of Artificial Sequence: Synthetic polypeptide
  XENP21478 Human IL15

SEQ ID NO: 469 - protein, 231 aa, Artificial Sequence; identical to SEQ ID NO: 27
  Description of Artificial Sequence: Synthetic polypeptide
  Fc Chain of XENP21478

SEQ ID NO: 470 - protein, 231 aa, Artificial Sequence; identical to SEQ ID NO: 26
  Description of Artificial Sequence: Synthetic polypeptide
  XENP21478 Chain 2 - empty-Fc(216)_IgG1_C220S/PVA_ /S267K/S364K/E357Q (8924)

SEQ ID NO: 471 - protein, 114 aa, Artificial Sequence; identical to SEQ ID NO: 2
  Description of Artificial Sequence: Synthetic polypeptide
  XENP21479 Chain 1 - human_IL15_no_tag (16484)

SEQ ID NO: 472 - protein, 231 aa, Artificial Sequence; identical to SEQ ID NO: 27
  Description of Artificial Sequence: Synthetic polypeptide
  XENP21479 Chain 2 - empty-Fc(216)_IgG1_pI(-)_Isosteric_A_ C220S/PVA_/S267K/L368D/K370S (8793)

SEQ ID NO: 473 - protein, 296 aa, Artificial Sequence; identical to SEQ ID NO: 61
  Description of Artificial Sequence: Synthetic polypeptide
  XENP21479 Chain 3 - human_IL15Ralpha(Sushi)-Fc(216)_IgG1_ C220S/PVA_/S267K/S364K/E357Q (16481)

SEQ ID NO: 474 - protein, 65 aa, Artificial Sequence; identical to SEQ ID NO: 4
  Description of Artificial Sequence: Synthetic polypeptide
  XENP21479 Human IL15Ralpha(Sushi)

SEQ ID NO: 475 - protein, 231 aa, Artificial Sequence; identical to SEQ ID NO: 26
  Description of Artificial Sequence: Synthetic polypeptide
  Fc Chain of XENP21479

SEQ ID NO: 476 - protein, 296 aa, Artificial Sequence; identical to SEQ ID NO: 84
  Description of Artificial Sequence: Synthetic polypeptide
  XENP021978 Chain 1 - human_IL15Ralpha(Sushi)-Fc(216)_IgG1_ C220S/PVA_/S267K (17023)

SEQ ID NO: 477 - protein, 65 aa, Artificial Sequence; identical to SEQ ID NO: 4
  Description of Artificial Sequence: Synthetic polypeptide
  XENP021978 Human IL15Ralpha(Sushi)

SEQ ID NO: 478 - protein, 231 aa, Artificial Sequence; identical to SEQ ID NO: 48
  Description of Artificial Sequence: Synthetic polypeptide
  Fc Chain of XENP021978

SEQ ID NO: 479 - protein, 114 aa, Artificial Sequence; identical to SEQ ID NO: 2
  Description of Artificial Sequence: Synthetic polypeptide
  XENP021978 Chain 2 - human_IL15_no_tag (16484)

SEQ ID NO: 480 - protein, 296 aa, Artificial Sequence; identical to SEQ ID NO: 84
  Description of Artificial Sequence: Synthetic polypeptide
  XENP021979 Chain 1 - human_IL15Ralpha(Sushi)-Fc(216)_IgG1_ C220S/PVA_/S267K (17023)

SEQ ID NO: 481 - protein, 65 aa, Artificial Sequence; identical to SEQ ID NO: 4
  Description of Artificial Sequence: Synthetic polypeptide
  XENP021979 Human IL15Ralpha(Sushi)

SEQ ID NO: 482 - protein, 231 aa, Artificial Sequence; identical to SEQ ID NO: 48
  Description of Artificial Sequence: Synthetic polypeptide
  Fc Chain of XENP021979

SEQ ID NO: 483 - protein, 114 aa, Artificial Sequence
  Description of Artificial Sequence: Synthetic polypeptide
  XENP021979 Chain 2 - human_IL15_N72D_no_tag (17076)
NWVNVISDLKKIEDLIQSMHIDATLYTESDVHPSCKVTAMKCFLLELQVISLESGDASIHDTVENLIILANDSLSSNGNVTESGCKECEELEEKNIKEFLQSFVHIVQMFINTS

SEQ ID NO: 484 - protein, 350 aa, Artificial Sequence; identical to SEQ ID NO: 52
  Description of Artificial Sequence: Synthetic polypeptide
  XENP021988 Chain 1 - human_IL15_(GGGGS)1_Fc(216)_IgG1_pI(-)_ Isosteric_A_C220S/PVA_/S267K/L368D/K370S

SEQ ID NO: 485 - protein, 114 aa, Artificial Sequence; identical to SEQ ID NO: 2
  Description of Artificial Sequence: Synthetic polypeptide
  XENP021988 Human IL15

SEQ ID NO: 486 - protein, 231 aa, Artificial Sequence; identical to SEQ ID NO: 27
  Description of Artificial Sequence: Synthetic polypeptide
  Fc Chain of XENP021988

SEQ ID NO: 487 - protein, 302 aa, Artificial Sequence
  Description of Artificial Sequence: Synthetic polypeptide
  XENP021988 Chain 2 - human_IL15Ralpha(Sushi-D96)_(GGGGS)1_ c(216)_IgG1_C220S/PVA_/S267K/S364K/E357Q
ITCPPPMSVEHADIWVKSYSLYSRERYICNSGFKRKAGTSSLTECVLNKATNVAHWTTPSLKCIRDGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 488 - protein, 66 aa, Artificial Sequence; identical to SEQ ID NO: 102
  Description of Artificial Sequence: Synthetic polypeptide
  XENP021988 Human IL15Ralpha(Sushi)

SEQ ID NO: 489 - protein, 231 aa, Artificial Sequence; identical to SEQ ID NO: 26
  Description of Artificial Sequence: Synthetic polypeptide
  Fc Chain of XENP021988

SEQ ID NO: 490 - protein, 350 aa, Artificial Sequence; identical to SEQ ID NO: 52
  Description of Artificial Sequence: Synthetic polypeptide
  XENP021989 Chain 1 - human_IL15_(GGGGS)1_(GGGGS)1_Fc(216)_IgG1_ pI(-)_Isosteric_A_C220S/PVA_/S267K/L368D/K370S

SEQ ID NO: 491 - protein, 114 aa, Artificial Sequence; identical to SEQ ID NO: 2
  Description of Artificial Sequence: Synthetic polypeptide
  XENP021989 Human IL15

SEQ ID NO: 492 - protein, 231 aa, Artificial Sequence; identical to SEQ ID NO: 27
  Description of Artificial Sequence: Synthetic polypeptide
  Fc Chain of XENP021989

SEQ ID NO: 493 - protein, 303 aa, Artificial Sequence
  Description of Artificial Sequence: Synthetic polypeptide
  XENP021989 Chain 2 - human_IL15Ralpha(Sushi-D96/P97)_(GGGGS)1_ Fc(216)_IgG1_C220S/PVA_/S267K/S364K/E357Q
ITCPPPMSVEHADIWVKSYSLYSRERYICNSGFKRKAGTSSLTECVLNKATNVAHWTTPSLKCIRDPGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 494 - protein, 67 aa, Artificial Sequence; identical to SEQ ID NO: 103
  Description of Artificial Sequence: Synthetic polypeptide
  XENP021989 Human IL15Ralpha(Sushi)

SEQ ID NO: 495 - protein, 231 aa, Artificial Sequence; identical to SEQ ID NO: 26
  Description of Artificial Sequence: Synthetic polypeptide
  Fc Chain of XENP021989

SEQ ID NO: 496 - protein, 350 aa, Artificial Sequence; identical to SEQ ID NO: 52
  Description of Artificial Sequence: Synthetic polypeptide
  XENP021990 Chain 1 - human_IL15_(GGGGS)1_Fc(216)_IgG1_pI(-)_ Isosteric_A_C220S/PVA_/S267K/L368D/K370S

SEQ ID NO: 497 - protein, 114 aa, Artificial Sequence; identical to SEQ ID NO: 2
  Description of Artificial Sequence: Synthetic polypeptide
  XENP021990 Human IL15

SEQ ID NO: 498 - protein, 231 aa, Artificial Sequence; identical to SEQ ID NO: 27
  Description of Artificial Sequence: Synthetic polypeptide
  Fc Chain of XENP021990

SEQ ID NO: 499 - protein, 304 aa, Artificial Sequence
  Description of Artificial Sequence: Synthetic polypeptide
  XENP021990 Chain 2 - human_IL15Ralpha(Sushi-D96/P97/A98)_ (GGGGS)1_ Fc(216)_IgG1_C220S/PVA_/S267K/S364K/E357Q
ITCPPPMSVEHADIWVKSYSLYSRERYICNSGFKRKAGTSSLTECVLNKATNVAHWTTPSLKCIRDPAGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 500 - protein, 68 aa, Artificial Sequence; identical to SEQ ID NO: 104
  Description of Artificial Sequence: Synthetic polypeptide
  XENP021990 Human IL15Ralpha(Sushi)

SEQ ID NO: 501 - protein, 231 aa, Artificial Sequence; identical to SEQ ID NO: 26
  Description of Artificial Sequence: Synthetic polypeptide
  Fc Chain of XENP021990

SEQ ID NO: 502 - protein, 350 aa, Artificial Sequence; identical to SEQ ID NO: 52
  Description of Artificial Sequence: Synthetic polypeptide
  XENP021991 Chain 1 - human_IL15_(GGGGS)1_Fc(216)_IgG1_pI(-)_ Isosteric_A_C220S/PVA_/S267K/L368D/K370S

SEQ ID NO: 503 - protein, 114 aa, Artificial Sequence; identical to SEQ ID NO: 2
  Description of Artificial Sequence: Synthetic polypeptide
  XENP021991 Human IL15

SEQ ID NO: 504 - protein, 231 aa, Artificial Sequence; identical to SEQ ID NO: 27
  Description of Artificial Sequence: Synthetic polypeptide
  Fc Chain of XENP021991

SEQ ID NO: 505 - protein, 299 aa, Artificial Sequence
  Description of Artificial Sequence: Synthetic polypeptide
  XENP021991 Chain 2 - human_IL15Ralpha(Sushi-D96/P97/A98)_ Fc(216)_IgG1_C220S/PVA_/S267K/S364K/E357Q
ITCPPPMSVEHADIWVKSYSLYSRERYICNSGFKRKAGTSSLTECVLNKATNVAHWTTPSLKCIRDPAEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 506 - protein, 68 aa, Artificial Sequence; identical to SEQ ID NO: 104
  Description of Artificial Sequence: Synthetic polypeptide
  XENP021991 Human IL15Ralpha(Sushi)

SEQ ID NO: 507 - protein, 231 aa, Artificial Sequence; identical to SEQ ID NO: 26
  Description of Artificial Sequence: Synthetic polypeptide
  Fc Chain of XENP021991

SEQ ID NO: 508 - protein, 345 aa, Artificial Sequence; identical to SEQ ID NO: 58
  Description of Artificial Sequence: Synthetic polypeptide
  XENP021992 Chain 1 - human_IL15_Fc(216)_IgG1_pI(-)_Isosteric_A_ C220S/PVA_/S267K/L368D/K370S

SEQ ID NO: 509 - protein, 114 aa, Artificial Sequence; identical to SEQ ID NO: 2
  Description of Artificial Sequence: Synthetic polypeptide
  XENP021992 Human IL15

SEQ ID NO: 510 - protein, 231 aa, Artificial Sequence; identical to SEQ ID NO: 27
  Description of Artificial Sequence: Synthetic polypeptide
  Fc Chain of XENP021992

SEQ ID NO: 511 - protein, 299 aa, Artificial Sequence; identical to SEQ ID NO: 505
  Description of Artificial Sequence: Synthetic polypeptide
  XENP021992 Chain 2 - human_IL15Ralpha(Sushi-D96/P97/A98)_ Fc(216)_IgG1_C220S/PVA_/S267K/S364K/E357Q

SEQ ID NO: 512 - protein, 68 aa, Artificial Sequence; identical to SEQ ID NO: 104
  Description of Artificial Sequence: Synthetic polypeptide
  XENP021992 Human IL15Ralpha(Sushi)

SEQ ID NO: 513 - protein, 231 aa, Artificial Sequence; identical to SEQ ID NO: 26
  Description of Artificial Sequence: Synthetic polypeptide
  Fc Chain of XENP021992

SEQ ID NO: 514 - protein, 435 aa, Artificial Sequence
  Description of Artificial Sequence: Synthetic polypeptide
  XENP021993 Chain 1 - human_IL15Ralpha(sushi)_(GGGGS)5-human_ IL15(single-chain)_Fc(216)_IgG1_pI(-)_Isosteric_ A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 515 - protein, 65 aa, Artificial Sequence; identical to SEQ ID NO: 4
  Description of Artificial Sequence: Synthetic polypeptide
  XENP021993 Human IL15Ralpha(Sushi)

SEQ ID NO: 516 - protein, 114 aa, Artificial Sequence; identical to SEQ ID NO: 2
  Description of Artificial Sequence: Synthetic polypeptide
  XENP021993 Human IL15

SEQ ID NO: 517 - protein, 231 aa, Artificial Sequence; identical to SEQ ID NO: 27
  Description of Artificial Sequence: Synthetic polypeptide
  Fc Chain of XENP021993

SEQ ID NO: 518 - protein, 231 aa, Artificial Sequence; identical to SEQ ID NO: 26
  Description of Artificial Sequence: Synthetic polypeptide
  XENP021993 Chain 2 - empty_Fc(216)_IgG1_C220S/PVA_ /S267K/S364K/E357Q

SEQ ID NO: 519 - protein, 430 aa, Artificial Sequence
  Description of Artificial Sequence: Synthetic polypeptide
  XENP021994 Chain 1 - human_IL15Ralpha(sushi)_(GGGGS)4-human_ IL15(single-chain) _Fc(216)_IgG1_pI(-)_Isosteric_ A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 520 - protein, 65 aa, Artificial Sequence; identical to SEQ ID NO: 4
  Description of Artificial Sequence: Synthetic polypeptide
  XENP021994 Human IL15Ralpha(Sushi)

SEQ ID NO: 521 - protein, 114 aa, Artificial Sequence; identical to SEQ ID NO: 2
  Description of Artificial Sequence: Synthetic polypeptide
  XENP021994 Human IL15

SEQ ID NO: 522 - protein, 231 aa, Artificial Sequence; identical to SEQ ID NO: 27
  Description of Artificial Sequence: Synthetic polypeptide
  Fc Chain of XENP021994

SEQ ID NO: 523 - protein, 231 aa, Artificial Sequence; identical to SEQ ID NO: 26
  Description of Artificial Sequence: Synthetic polypeptide
  XENP021994 Chain 2 - empty_ Fc(216)_IgG1_C220S/PVA_ /S267K/S364K/E357Q

SEQ ID NO: 524 - protein, 425 aa, Artificial Sequence
  Description of Artificial Sequence: Synthetic polypeptide
  XENP021995 Chain 1 - human_IL15Ralpha(sushi)_(GGGGS)3-human_ IL15(single-chain)_Fc(216)_IgG1_pI(-)_Isosteric_ A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 525 - protein, 65 aa, Artificial Sequence; identical to SEQ ID NO: 4
  Description of Artificial Sequence: Synthetic polypeptide
  XENP021995 Human IL15Ralpha(Sushi)

SEQ ID NO: 526 - protein, 114 aa, Artificial Sequence; identical to SEQ ID NO: 2
  Description of Artificial Sequence: Synthetic polypeptide
  XENP021995 Human IL15

SEQ ID NO: 527 - protein, 231 aa, Artificial Sequence; identical to SEQ ID NO: 27
  Description of Artificial Sequence: Synthetic polypeptide
  Fc Chain of XENP021995

SEQ ID NO: 528 - protein, 231 aa, Artificial Sequence; identical to SEQ ID NO: 26
  Description of Artificial Sequence: Synthetic polypeptide
  XENP021995 Chain 2 - empty_Fc(216)_IgG1_C220S/PVA_ /S267K/S364K/E357Q

SEQ ID NO: 529 - protein, 114 aa, Artificial Sequence; identical to SEQ ID NO: 2
  Description of Artificial Sequence: Synthetic polypeptide
  XENP021996 Chain 1 - human_IL15_no_tag (16484)

SEQ ID NO: 530 - protein, 65 aa, Artificial Sequence; identical to SEQ ID NO: 4
  Description of Artificial Sequence: Synthetic polypeptide
  XENP021996 Chain 2 - human_IL15Ralpha(Sushi)-6x-His (17033)

SEQ ID NO: 531 - protein, 114 aa, Artificial Sequence; identical to SEQ ID NO: 2
  Description of Artificial Sequence: Synthetic polypeptide
  XENP022001 Chain 1 - human_IL15_no_tag (16484)

SEQ ID NO: 532 - protein, 66 aa, Artificial Sequence; identical to SEQ ID NO: 102
  Description of Artificial Sequence: Synthetic polypeptide
  XENP022001 Chain 2 - human_ IL15Ralpha(Sushi-D96)-6x-His (17048)

SEQ ID NO: 533 - protein, 114 aa, Artificial Sequence; identical to SEQ ID NO: 2
  Description of Artificial Sequence: Synthetic polypeptide
  XENP022002 Chain 1 - human_IL15_no_tag (16484)

SEQ ID NO: 534 - protein, 67 aa, Artificial Sequence; identical to SEQ ID NO: 103
  Description of Artificial Sequence: Synthetic polypeptide
  XENP022002 Chain 2 - human_ IL15Ralpha(Sushi-D96/P97)-6x-His (17049)

SEQ ID NO: 535 - protein, 114 aa, Artificial Sequence; identical to SEQ ID NO: 2
  Description of Artificial Sequence: Synthetic polypeptide
  XENP022003 Chain 1 - human_IL15_no_tag (16484)

SEQ ID NO: 536 - protein, 68 aa, Artificial Sequence; identical to SEQ ID NO: 104
  Description of Artificial Sequence: Synthetic polypeptide
  XENP022003 Chain 2 - human_ IL15Ralpha(Sushi-D96/P97/A98)-6x-His (17050)

SEQ ID NO: 537 - protein, 114 aa, Artificial Sequence; identical to SEQ ID NO: 2
  Description of Artificial Sequence: Synthetic polypeptide
  XENP022004 Chain 1 - human_IL15_E87C_no_tag (17074)

SEQ ID NO: 538 - protein, 67 aa, Artificial Sequence; identical to SEQ ID NO: 113
  Description of Artificial Sequence: Synthetic polypeptide
  XENP022004 Chain 2 - human_ IL15Ralpha(Sushi-D96/C97)-6x-His (17051)

SEQ ID NO: 539 - protein, 114 aa, Artificial Sequence; identical to SEQ ID NO: 2
  Description of Artificial Sequence: Synthetic polypeptide
  XENP022005 Chain 1 - human_IL15_E87C_no_tag (17074)

SEQ ID NO: 540 - protein, 68 aa, Artificial Sequence; identical to SEQ ID NO: 114
  Description of Artificial Sequence: Synthetic polypeptide
  XENP022005 Chain 2 - human_ IL15Ralpha(Sushi-D96/P97/C98)-6x-His (17052)

SEQ ID NO: 541 - protein, 114 aa, Artificial Sequence; identical to SEQ ID NO: 2
  Description of Artificial Sequence: Synthetic polypeptide
  XENP022006 Chain 1 - human_IL15_E87C_no_tag (17074)

SEQ ID NO: 542 - protein, 68 aa, Artificial Sequence; identical to SEQ ID NO: 115
  Description of Artificial Sequence: Synthetic polypeptide
  XENP022006 Chain 2 - human_ IL15Ralpha(Sushi-D96/C97/A98)-6x-His (17053)

SEQ ID NO: 543 - protein, 114 aa, Artificial Sequence; identical to SEQ ID NO: 106
  Description of Artificial Sequence: Synthetic polypeptide
  XENP022007 Chain 1 - human_IL15_V49C_no_tag (17071)

SEQ ID NO: 544 - protein, 65 aa, Artificial Sequence; identical to SEQ ID NO: 116
  Description of Artificial Sequence: Synthetic polypeptide
  XENP022007 Chain 2 - human_ IL15Ralpha(Sushi-S40C)-6x-His (17057)

SEQ ID NO: 545 - protein, 114 aa, Artificial Sequence; identical to SEQ ID NO: 107
  Description of Artificial Sequence: Synthetic polypeptide
  XENP022008 Chain 1 - human_IL15_L52C_no_tag (17072)

SEQ ID NO: 546 - protein, 65 aa, Artificial Sequence; identical to SEQ ID NO: 116
  Description of Artificial Sequence: Synthetic polypeptide
  XENP022008 Chain 2 - human_ IL15Ralpha(Sushi-S40C)-6x-His (17057)

SEQ ID NO: 547 - protein, 114 aa, Artificial Sequence; identical to SEQ ID NO: 108
  Description of Artificial Sequence: Synthetic polypeptide
  XENP022009 Chain 1 - human_IL15_E89C_no_tag (17075)

SEQ ID NO: 548 - protein, 65 aa, Artificial Sequence; identical to SEQ ID NO: 117
  Description of Artificial Sequence: Synthetic polypeptide
  XENP022009 Chain 2 - human_ IL15Ralpha(Sushi-K34C)-6x-His (17054)

SEQ ID NO: 549 - protein, 114 aa, Artificial Sequence; identical to SEQ ID NO: 109
  Description of Artificial Sequence: Synthetic polypeptide
  XENP022010 Chain 1 - human_IL15_Q48C_no_tag (17070)

SEQ ID NO: 550 - protein, 65 aa, Artificial Sequence; identical to SEQ ID NO: 118
  Description of Artificial Sequence: Synthetic polypeptide
  XENP022010 Chain 2 - human_ IL15Ralpha(Sushi-G38C)-6x-His (17056)

SEQ ID NO: 551 - protein, 114 aa, Artificial Sequence; identical to SEQ ID NO: 110
  Description of Artificial Sequence: Synthetic polypeptide
  XENP022011 Chain 1 - human_IL15_E53C_no_tag (17073)

SEQ ID NO: 552 - protein, 65 aa, Artificial Sequence; identical to SEQ ID NO: 119
  Description of Artificial Sequence: Synthetic polypeptide
  XENP022011 Chain 2 - human_ IL15Ralpha(Sushi-L42C)-6x-His (17058)

SEQ ID NO: 553 - protein, 114 aa, Artificial Sequence; identical to SEQ ID NO: 111
  Description of Artificial Sequence: Synthetic polypeptide
  XENP022012 Chain 1 - human_IL15_C42S_no_tag (17083)

SEQ ID NO: 554 - protein, 65 aa, Artificial Sequence; identical to SEQ ID NO: 120
  Description of Artificial Sequence: Synthetic polypeptide
  XENP022012 Chain 2 - human_ IL15Ralpha(Sushi-L42C)-6x-His (17055)

SEQ ID NO: 555 - protein, 350 aa, Artificial Sequence; identical to SEQ ID NO: 136
  Description of Artificial Sequence: Synthetic polypeptide
  XENP022013 Chain 1 - human_IL15_E87C_(GGGGS)1_Fc(216)_IgG1_ pI(-)_Isosteric_A_C220S/PVA_/S267K/L368D/K370S

SEQ ID NO: 556 - protein, 114 aa, Artificial Sequence; identical to SEQ ID NO: 105
  Description of Artificial Sequence: Synthetic polypeptide
  XENP022013 Human IL15

SEQ ID NO: 557 - protein, 231 aa, Artificial Sequence; identical to SEQ ID NO: 27
  Description of Artificial Sequence: Synthetic polypeptide
  Fc Chain of XENP022013

SEQ ID NO: 558 - protein, 303 aa, Artificial Sequence; identical to SEQ ID NO: 139
  Description of Artificial Sequence: Synthetic polypeptide
  XENP022013 Chain 2 - human_IL15Ralpha(Sushi-D96/C97)_(GGGGS)1_ Fc(216)_IgG1_C220S/PVA_/S267K/S364K/E357Q

SEQ ID NO: 559 - protein, 67 aa, Artificial Sequence; identical to SEQ ID NO: 113
  Description of Artificial Sequence: Synthetic polypeptide
  XENP022013 Human IL15Ralpha(Sushi)

SEQ ID NO: 560 - protein, 231 aa, Artificial Sequence; identical to SEQ ID NO: 26
  Description of Artificial Sequence: Synthetic polypeptide
  Fc Chain of XENP022013

SEQ ID NO: 561 - protein, 350 aa, Artificial Sequence; identical to SEQ ID NO: 136
  Description of Artificial Sequence: Synthetic polypeptide
  XENP022014 Chain 1 - human_IL15_E87C_(GGGGS)1_Fc(216)_IgG1_ pI(-)_Isosteric_A_C220S/PVA_/S267K/L368D/K370S

SEQ ID NO: 562 - protein, 114 aa, Artificial Sequence; identical to SEQ ID NO: 105
  Description of Artificial Sequence: Synthetic polypeptide
  XENP022014 Human IL15

SEQ ID NO: 563 - protein, 231 aa, Artificial Sequence; identical to SEQ ID NO: 27
  Description of Artificial Sequence: Synthetic polypeptide
  Fc Chain of XENP022014

SEQ ID NO: 564 - protein, 304 aa, Artificial Sequence; identical to SEQ ID NO: 145
  Description of Artificial Sequence: Synthetic polypeptide
  XENP022014 Chain 2 - human_IL15Ralpha(Sushi-D96/P97/C98)_ (GGGGS)1_Fc(216)_IgG1_C220S/PVA_/S267K/S364K/E357Q

SEQ ID NO: 565 - protein, 68 aa, Artificial Sequence; identical to SEQ ID NO: 114
  Description of Artificial Sequence: Synthetic polypeptide
  XENP022014 Human IL15Ralpha(Sushi)

SEQ ID NO: 566 - protein, 231 aa, Artificial Sequence; identical to SEQ ID NO: 26
  Description of Artificial Sequence: Synthetic polypeptide
  Fc Chain of XENP022014

SEQ ID NO: 567 - protein, 350 aa, Artificial Sequence; identical to SEQ ID NO: 136
  Description of Artificial Sequence: Synthetic polypeptide
  XENP022015 Chain 1 - human_IL15_E87C_(GGGGS)1_Fc(216)_IgG1_ pI(-)_Isosteric_A_C220S/PVA_/S267K/L368D/K370S

SEQ ID NO: 568 - protein, 114 aa, Artificial Sequence; identical to SEQ ID NO: 105
  Description of Artificial Sequence: Synthetic polypeptide
  XENP022015 Human IL15

SEQ ID NO: 569 - protein, 231 aa, Artificial Sequence; identical to SEQ ID NO: 27
  Description of Artificial Sequence: Synthetic polypeptide
  Fc Chain of XENP022015

SEQ ID NO: 570 - protein, 304 aa, Artificial Sequence; identical to SEQ ID NO: 151
  Description of Artificial Sequence: Synthetic polypeptide
  XENP022015 Chain 2 - human_IL15Ralpha(Sushi-D96/C97/A98)_ (GGGGS)1_Fc(216)_IgG1_C220S/PVA_/S267K/S364K/E357Q

SEQ ID NO: 571 - protein, 68 aa, Artificial Sequence; identical to SEQ ID NO: 115
  Description of Artificial Sequence: Synthetic polypeptide
  XENP022015 Human IL15Ralpha(Sushi)

SEQ ID NO: 572 - protein, 231 aa, Artificial Sequence; identical to SEQ ID NO: 26
  Description of Artificial Sequence: Synthetic polypeptide
  Fc Chain of XENP022015

SEQ ID NO: 573 - protein, 350 aa, Artificial Sequence; identical to SEQ ID NO: 154
  Description of Artificial Sequence: Synthetic polypeptide
  XENP022017 Chain 1 - human_IL15_L52C_(GGGGS)1-_Fc(216)_IgG1_ pI(-)_Isosteric_A_C220S/PVA_/S267K/L368D/K370S

SEQ ID NO: 574 - protein, 114 aa, Artificial Sequence; identical to SEQ ID NO: 107
  Description of Artificial Sequence: Synthetic polypeptide
  XENP022017 Human IL15

SEQ ID NO: 575 - protein, 231 aa, Artificial Sequence; identical to SEQ ID NO: 27
  Description of Artificial Sequence: Synthetic polypeptide
  Fc Chain of XENP022017

SEQ ID NO: 576 - protein, 301 aa, Artificial Sequence; identical to SEQ ID NO: 157
  Description of Artificial Sequence: Synthetic polypeptide
  XENP022017 Chain 2 - human_IL15Ralpha(Sushi-S40C)_(GGGGS)1_ Fc(216)_IgG1_C220S/PVA_/S267K/S364K/E357Q

SEQ ID NO: 577 - protein, 65 aa, Artificial Sequence; identical to SEQ ID NO: 116
  Description of Artificial Sequence: Synthetic polypeptide
  XENP022017 Human IL15Ralpha(Sushi)

SEQ ID NO: 578 - protein, 231 aa, Artificial Sequence; identical to SEQ ID NO: 26
  Description of Artificial Sequence: Synthetic polypeptide
  Fc Chain of XENP022017

SEQ ID NO: 579 - protein, 209 aa, Artificial Sequence; identical to SEQ ID NO: 133
  Description of Artificial Sequence: Synthetic polypeptide
  XENP022049 Chain 1 - human_IL15Ralpha(sushi)_(GGGGS)6-human_ IL15-sc-6x-His (17032)

SEQ ID NO: 580 - protein, 65 aa, Artificial Sequence; identical to SEQ ID NO: 4
  Description of Artificial Sequence: Synthetic polypeptide
  XENP022049 Human IL15Ralpha(Sushi)

SEQ ID NO: 581 - protein, 114 aa, Artificial Sequence; identical to SEQ ID NO: 2
  Description of Artificial Sequence: Synthetic polypeptide
  XENP022049 Human IL15

SEQ ID NO: 582 - protein, 114 aa, Artificial Sequence; identical to SEQ ID NO: 2
  Description of Artificial Sequence: Synthetic polypeptide
  XENP022354 Chain 1 - human_IL15_no_tag (16484)

SEQ ID NO: 583 - protein, 231 aa, Artificial Sequence; identical to SEQ ID NO: 27
  Description of Artificial Sequence: Synthetic polypeptide
  XENP022354 Chain 2 - empty-Fc(216)_IgG1_pI(-)_Isosteric_A_ C220S/PVA_/S267K/L368D/K370S (8793)

SEQ ID NO: 584 - protein, 302 aa, Artificial Sequence; identical to SEQ ID NO: 487
  Description of Artificial Sequence: Synthetic polypeptide
  XENP022354 Chain 3 - human_IL15Ralpha(Sushi-D96)_(GGGGS)1_ Fc(216)_IgG1_C220S/PVA_/S267K/S364K/E357Q (17034)

SEQ ID NO: 585 - protein, 66 aa, Artificial Sequence; identical to SEQ ID NO: 102
  Description of Artificial Sequence: Synthetic polypeptide
  XENP022354 Human IL15Ralpha(Sushi)

SEQ ID NO: 586 - protein, 231 aa, Artificial Sequence; identical to SEQ ID NO: 26
  Description of Artificial Sequence: Synthetic polypeptide
  Fc Chain of XENP022354

SEQ ID NO: 587 - protein, 114 aa, Artificial Sequence; identical to SEQ ID NO: 2
  Description of Artificial Sequence: Synthetic polypeptide
  XENP022355 Chain 1 - human_IL15_no_tag (16484)

SEQ ID NO: 588 - protein, 231 aa, Artificial Sequence; identical to SEQ ID NO: 27
  Description of Artificial Sequence: Synthetic polypeptide
  XENP022355 Chain 2 - empty-Fc(216)_IgG1_pI(-)_Isosteric_A_ C220S/PVA_/S267K/L368D/K370S (8793)

SEQ ID NO: 589 - protein, 303 aa, Artificial Sequence; identical to SEQ ID NO: 493
  Description of Artificial Sequence: Synthetic polypeptide
  XENP022355 Chain 3 - human_IL15Ralpha(Sushi-D96/P97)_(GGGGS)1_ Fc(216)_IgG1_C220S/PVA_/S267K/S364K/E357Q

SEQ ID NO: 590 - protein, 67 aa, Artificial Sequence; identical to SEQ ID NO: 103
  Description of Artificial Sequence: Synthetic polypeptide
  XENP022355 Human IL15Ralpha(Sushi)

SEQ ID NO: 591 - protein, 231 aa, Artificial Sequence; identical to SEQ ID NO: 26
  Description of Artificial Sequence: Synthetic polypeptide
  Fc Chain of XENP022355

SEQ ID NO: 592 - protein, 114 aa, Artificial Sequence; identical to SEQ ID NO: 2
  Description of Artificial Sequence: Synthetic polypeptide
  XENP022356 Chain 1 - human_IL15_no_tag (16484)

SEQ ID NO: 593 - protein, 231 aa, Artificial Sequence; identical to SEQ ID NO: 27
  Description of Artificial Sequence: Synthetic polypeptide
  XENP022356 Chain 2 - empty-Fc(216)_IgG1_pI(-)_Isosteric_A_ C220S/PVA_/S267K/L368D/K370S (8793)

SEQ ID NO: 594 - protein, 304 aa, Artificial Sequence; identical to SEQ ID NO: 499
  Description of Artificial Sequence: Synthetic polypeptide
  XENP022356 Chain 3 - human_IL15Ralpha(Sushi-D96/P97/A98)_ (GGGGS)1_Fc(216)_IgG1_C220S/PVA_/S267K/S364K/E357Q (17036)

SEQ ID NO: 595 - protein, 68 aa, Artificial Sequence; identical to SEQ ID NO: 104
  Description of Artificial Sequence: Synthetic polypeptide
  XENP022356 Human IL15Ralpha(Sushi)

SEQ ID NO: 596 - protein, 231 aa, Artificial Sequence; identical to SEQ ID NO: 26
  Description of Artificial Sequence: Synthetic polypeptide
  Fc Chain of XENP022356

SEQ ID NO: 597 - protein, 114 aa, Artificial Sequence; identical to SEQ ID NO: 105
  Description of Artificial Sequence: Synthetic polypeptide
  XENP022357 Chain 1 - human_IL15_E87C_no_tag (17074)

SEQ ID NO: 598 - protein, 231 aa, Artificial Sequence; identical to SEQ ID NO: 27
  Description of Artificial Sequence: Synthetic polypeptide
  XENP022357 Chain 2 - empty-Fc(216)_IgG1_pI(-)_Isosteric_A_ C220S/PVA_/S267K/L368D/K370S (8793)

SEQ ID NO: 599 - protein, 303 aa, Artificial Sequence; identical to SEQ ID NO: 139
  Description of Artificial Sequence: Synthetic polypeptide
  XENP022357 Chain 3 - human_IL15Ralpha(Sushi-D96/C97)_(GGGGS)1_ Fc(216)_IgG1_C220S/PVA_/S267K/S364K/E357Q (17038)

SEQ ID NO: 600 - protein, 67 aa, Artificial Sequence; identical to SEQ ID NO: 113
  Description of Artificial Sequence: Synthetic polypeptide
  XENP022357 Human IL15Ralpha(Sushi)

SEQ ID NO: 601 - protein, 231 aa, Artificial Sequence; identical to SEQ ID NO: 26
  Description of Artificial Sequence: Synthetic polypeptide
  Fc Chain of XENP022357

SEQ ID NO: 602 - protein, 114 aa, Artificial Sequence; identical to SEQ ID NO: 105
  Description of Artificial Sequence: Synthetic polypeptide
  XENP022358 Chain 1 - human_IL15_E87C_no_tag (17074)

SEQ ID NO: 603 - protein, 231 aa, Artificial Sequence; identical to SEQ ID NO: 27
  Description of Artificial Sequence: Synthetic polypeptide
  XENP022358 Chain 2 - empty-Fc(216)_IgG1_pI(-)_Isosteric_A_ C220S/PVA_/S267K/L368D/K370S (8793)

SEQ ID NO: 604 - protein, 304 aa, Artificial Sequence; identical to SEQ ID NO: 145
  Description of Artificial Sequence: Synthetic polypeptide
  XENP022358 Chain 3 - human_IL15Ralpha(Sushi-D96/P97/C98)_ (GGGGS)1_Fc(216)_IgG1_C220S/PVA_/S267K/S364K/E357Q (17039)

SEQ ID NO: 605 - protein, 68 aa, Artificial Sequence; identical to SEQ ID NO: 114
  Description of Artificial Sequence: Synthetic polypeptide
  XENP022358 Human IL15Ralpha(Sushi)

SEQ ID NO: 606 - protein, 231 aa, Artificial Sequence; identical to SEQ ID NO: 26
  Description of Artificial Sequence: Synthetic polypeptide
  Fc Chain of XENP022358

SEQ ID NO: 607 - protein, 114 aa, Artificial Sequence; identical to SEQ ID NO: 105
  Description of Artificial Sequence: Synthetic polypeptide
  XENP022359 Chain 1 - human_IL15_E87C_no_tag (17074)

SEQ ID NO: 608 - protein, 231 aa, Artificial Sequence; identical to SEQ ID NO: 27
  Description of Artificial Sequence: Synthetic polypeptide
  XENP022359 Chain 2 - empty-Fc(216)_IgG1_pI(-)_Isosteric_A_ C220S/PVA_/S267K/L368D/K370S (8793)

SEQ ID NO: 609 - protein, 304 aa, Artificial Sequence; identical to SEQ ID NO: 151
  Description of Artificial Sequence: Synthetic polypeptide
  XENP022359 Chain 3 - human_IL15Ralpha(Sushi-D96/C97/A98)_ (GGGGS)1_Fc(216)_IgG1_C220S/PVA_/S267K/S364K/E357Q (17040)

SEQ ID NO: 610 - protein, 68 aa, Artificial Sequence; identical to SEQ ID NO: 115
  Description of Artificial Sequence: Synthetic polypeptide
  XENP022359 Human IL15Ralpha(Sushi)

SEQ ID NO: 611 - protein, 231 aa, Artificial Sequence; identical to SEQ ID NO: 26
  Description of Artificial Sequence: Synthetic polypeptide
  Fc Chain of XENP022359

SEQ ID NO: 612 - protein, 114 aa, Artificial Sequence; identical to SEQ ID NO: 106
  Description of Artificial Sequence: Synthetic polypeptide
  XENP022360 Chain 1 - human_IL15_V49C_no_tag (17071)

SEQ ID NO: 613 - protein, 231 aa, Artificial Sequence; identical to SEQ ID NO: 27
  Description of Artificial Sequence: Synthetic polypeptide
  XENP022360 Chain 2 - empty-Fc(216)_IgG1_pI(-)_Isosteric_A_ C220S/PVA_/S267K/L368D/K370S (8793)

SEQ ID NO: 614 - protein, 301 aa, Artificial Sequence; identical to SEQ ID NO: 157
  Description of Artificial Sequence: Synthetic polypeptide
  XENP022360 Chain 3 - human_IL15Ralpha(Sushi-S40C)_(GGGGS)1_ Fc(216)_IgG1_C220S/PVA_/S267K/S364K/E357Q (17044)

SEQ ID NO: 615 - protein, 65 aa, Artificial Sequence; identical to SEQ ID NO: 116
  Description of Artificial Sequence: Synthetic polypeptide
  XENP022360 Human IL15Ralpha(Sushi)

SEQ ID NO: 616 - protein, 231 aa, Artificial Sequence; identical to SEQ ID NO: 26
  Description of Artificial Sequence: Synthetic polypeptide
  Fc Chain of XENP022360

SEQ ID NO: 617 - protein, 114 aa, Artificial Sequence; identical to SEQ ID NO: 107
  Description of Artificial Sequence: Synthetic polypeptide
  XENP022361 Chain 1 - human_IL15_L52C_no_tag (17072)

SEQ ID NO: 618 - protein, 231 aa, Artificial Sequence; identical to SEQ ID NO: 27
  Description of Artificial Sequence: Synthetic polypeptide
  XENP022361 Chain 2 - empty-Fc(216)_IgG1_pI(-)_Isosteric_A_ C220S/PVA_/S267K/L368D/K370S (8793)

SEQ ID NO: 619 - protein, 301 aa, Artificial Sequence; identical to SEQ ID NO: 157
  Description of Artificial Sequence: Synthetic polypeptide
  XENP022361 Chain 3 - human_IL15Ralpha(Sushi-S40C)_(GGGGS)1_ Fc(216)_IgG1_C220S/PVA_/S267K/S364K/E357Q (17044)

SEQ ID NO: 620 - protein, 65 aa, Artificial Sequence; identical to SEQ ID NO: 116
  Description of Artificial Sequence: Synthetic polypeptide
  XENP022361 Human IL15Ralpha(Sushi)

SEQ ID NO: 621 - protein, 231 aa, Artificial Sequence; identical to SEQ ID NO: 26
  Description of Artificial Sequence: Synthetic polypeptide
  Fc Chain of XENP022361

SEQ ID NO: 622 - protein, 114 aa, Artificial Sequence; identical to SEQ ID NO: 108
  Description of Artificial Sequence: Synthetic polypeptide
  XENP022362 Chain 1 - human_IL15_E89C_no_tag (17075)

SEQ ID NO: 623 - protein, 231 aa, Artificial Sequence; identical to SEQ ID NO: 27
  Description of Artificial Sequence: Synthetic polypeptide
  XENP022362 Chain 2 - empty-Fc(216)_IgG1_pI(-)_Isosteric_A_ C220S/PVA_/S267K/L368D/K370S (8793)

SEQ ID NO: 624 - protein, 301 aa, Artificial Sequence
  Description of Artificial Sequence: Synthetic polypeptide
  XENP022362 Chain 3 - human_IL15Ralpha(Sushi-K34C)_(GGGGS)1_ Fc(216)_IgG1_C220S/PVA_/S267K/S364K/E357Q (17041)
ITCPPPMSVEHADIWVKSYSLYSRERYICNSGFCRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 625 - protein, 65 aa, Artificial Sequence; identical to SEQ ID NO: 117
  Description of Artificial Sequence: Synthetic polypeptide
  XENP022362 Human IL15Ralpha(Sushi)

SEQ ID NO: 626 - protein, 231 aa, Artificial Sequence; identical to SEQ ID NO: 26
  Description of Artificial Sequence: Synthetic polypeptide
  Fc Chain of XENP022362

SEQ ID NO: 627 - protein, 114 aa, Artificial Sequence; identical to SEQ ID NO: 109
  Description of Artificial Sequence: Synthetic polypeptide
  XENP022363 Chain 1 - human_IL15_Q48C_no_tag (17070)

SEQ ID NO: 628 - protein, 231 aa, Artificial Sequence; identical to SEQ ID NO: 27
  Description of Artificial Sequence: Synthetic polypeptide
  XENP022363 Chain 2 - empty-Fc(216)_IgG1_pI(-)_Isosteric_A_ C220S/PVA_/S267K/L368D/K370S (8793)

SEQ ID NO: 629 - protein, 301 aa, Artificial Sequence
  Description of Artificial Sequence: Synthetic polypeptide
  XENP022363 Chain 3 - human_IL15Ralpha(Sushi-G38C)_(GGGGS)1_ Fc(216)_IgG1_C220S/PVA_/S267K/S364K/E357Q (17043)
ITCPPPMSVEHADIWVKSYSLYSRERYICNSGFKRKACTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 630 - protein, 65 aa, Artificial Sequence; identical to SEQ ID NO: 118
  Description of Artificial Sequence: Synthetic polypeptide
  XENP022363 Human IL15Ralpha(Sushi)

SEQ ID NO: 631 - protein, 231 aa, Artificial Sequence; identical to SEQ ID NO: 26
  Description of Artificial Sequence: Synthetic polypeptide
  Fc Chain of XENP022363

SEQ ID NO: 632 - protein, 114 aa, Artificial Sequence; identical to SEQ ID NO: 110
  Description of Artificial Sequence: Synthetic polypeptide
  XENP022364 Chain 1 - human_IL15_E53C_no_tag (17073)

SEQ ID NO: 633 - protein, 231 aa, Artificial Sequence; identical to SEQ ID NO: 27
  Description of Artificial Sequence: Synthetic polypeptide
  XENP022364 Chain 2 - empty-Fc(216)_IgG1_pI(-)_Isosteric_A_ C220S/PVA_/S267K/L368D/K370S (8793)

SEQ ID NO: 634 - protein, 301 aa, Artificial Sequence
  Description of Artificial Sequence: Synthetic polypeptide
  XENP022364 Chain 3 - human_IL15Ralpha(Sushi-L42C)_(GGGGS)1_ Fc(216)_IgG1_C220S/PVA_/S267K/S364K/E357Q (17045)
ITCPPPMSVEHADIWVKSYSLYSRERYICNSGFKRKAGTSSCTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 635 - protein, 65 aa, Artificial Sequence; identical to SEQ ID NO: 119
  Description of Artificial Sequence: Synthetic polypeptide
  XENP022364 Human IL15Ralpha(Sushi)

SEQ ID NO: 636 - protein, 231 aa, Artificial Sequence; identical to SEQ ID NO: 26
  Description of Artificial Sequence: Synthetic polypeptide
  Fc Chain of XENP022364

SEQ ID NO: 637 - protein, 114 aa, Artificial Sequence; identical to SEQ ID NO: 111
  Description of Artificial Sequence: Synthetic polypeptide
  XENP022365 Chain 1 - human_IL15_C42S_no_tag (17083)

SEQ ID NO: 638 - protein, 231 aa, Artificial Sequence; identical to SEQ ID NO: 27
  Description of Artificial Sequence: Synthetic polypeptide
  XENP022365 Chain 2 - empty-Fc(216)_IgG1_pI(-)_Isosteric_A_ C220S/PVA_/S267K/L368D/K370S (8793)

SEQ ID NO: 639 - protein, 301 aa, Artificial Sequence
  Description of Artificial Sequence: Synthetic polypeptide
  XENP022365 Chain 3 - human_IL15Ralpha(Sushi-A37C)_(GGGGS)1_ Fc(216)_IgG1_C220S/PVA_/S267K/S364K/E357Q (17042)
ITCPPPMSVEHADIWVKSYSLYSRERYICNSGFKRKCGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 640 - protein, 65 aa, Artificial Sequence; identical to SEQ ID NO: 120
  Description of Artificial Sequence: Synthetic polypeptide
  XENP022365 Human IL15Ralpha(Sushi)

SEQ ID NO: 641 - protein, 231 aa, Artificial Sequence; identical to SEQ ID NO: 26
  Description of Artificial Sequence: Synthetic polypeptide
  Fc Chain of XENP022365

SEQ ID NO: 642 - protein, 114 aa, Artificial Sequence; identical to SEQ ID NO: 2
  Description of Artificial Sequence: Synthetic polypeptide
  XENP022366 Chain 1 - human_IL15_no_tag (16484)

SEQ ID NO: 643 - protein, 231 aa, Artificial Sequence; identical to SEQ ID NO: 27
  Description of Artificial Sequence: Synthetic polypeptide
  XENP022366 Chain 2 - empty-Fc(216)_IgG1_pI(-)_Isosteric_A_ C220S/PVA_/S267K/L368D/K370S (8793)

SEQ ID NO: 644 - protein, 301 aa, Artificial Sequence; identical to SEQ ID NO: 55
  Description of Artificial Sequence: Synthetic polypeptide
  XENP022366 Chain 3 - human_IL15Ralpha(Sushi)_(GGGGS)1_Fc(216)_ IgG1_C220S/PVA_/S267K/S364K/E357Q (15908)

SEQ ID NO: 645 - protein, 65 aa, Artificial Sequence; identical to SEQ ID NO: 4
  Description of Artificial Sequence: Synthetic polypeptide
  XENP022366 Human IL15Ralpha(Sushi)

SEQ ID NO: 646 - protein, 231 aa, Artificial Sequence; identical to SEQ ID NO: 26
  Description of Artificial Sequence: Synthetic polypeptide
  Fc Chain of XENP022366

SEQ ID NO: 647 - protein, 114 aa, Artificial Sequence; identical to SEQ ID NO: 112
  Description of Artificial Sequence: Synthetic polypeptide
  XENP022493 Chain 1 - human_IL15_L45C_no_tag (17069)

SEQ ID NO: 648 - protein, 65 aa, Artificial Sequence; identical to SEQ ID NO: 118
  Description of Artificial Sequence: Synthetic polypeptide
  XENP022493 Chain 2 - human_ IL15Ralpha(Sushi-G38C)-6x-His (17056)

SEQ ID NO: 649 - protein, 114 aa, Artificial Sequence; identical to SEQ ID NO: 112
  Description of Artificial Sequence: Synthetic polypeptide
  XENP022494 Chain 1 - human_IL15_L45C_no_tag (17069)

SEQ ID NO: 650 - protein, 65 aa, Artificial Sequence; identical to SEQ ID NO: 120
  Description of Artificial Sequence: Synthetic polypeptide
  XENP022494 Chain 2 - human_ IL15Ralpha(Sushi-A37C)-6x-His (17055)

SEQ ID NO: 651 - protein, 298 aa, Artificial Sequence; identical to SEQ ID NO: 179
  Description of Artificial Sequence: Synthetic polypeptide
  XENP022634 Chain 1 - human_IL15Ralpha(Sushi-D96/C97)-Fc(216)_ IgG1_C220S/PVA_/S267K (17581)

SEQ ID NO: 652 - protein, 67 aa, Artificial Sequence; identical to SEQ ID NO: 113
  Description of Artificial Sequence: Synthetic polypeptide
  XENP022634 Human IL15Ralpha(Sushi)

SEQ ID NO: 653 - protein, 231 aa, Artificial Sequence; identical to SEQ ID NO: 48
  Description of Artificial Sequence: Synthetic polypeptide
  Fc Chain of XENP022634

SEQ ID NO: 654 - protein, 114 aa, Artificial Sequence; identical to SEQ ID NO: 105
  Description of Artificial Sequence: Synthetic polypeptide
  XENP022634 Chain 2 - human_IL15_E87C_no_tag (17074)

SEQ ID NO: 655 - protein, 299 aa, Artificial Sequence; identical to SEQ ID NO: 183
  Description of Artificial Sequence: Synthetic polypeptide
  XENP022635 Chain 1 - human_IL15Ralpha(Sushi-D96/C97/A98)- Fc(216)_IgG1_C220S/PVA_/S267K (17582)

SEQ ID NO: 656 - protein, 68 aa, Artificial Sequence; identical to SEQ ID NO: 115
  Description of Artificial Sequence: Synthetic polypeptide
  XENP022635 Human IL15Ralpha(Sushi)

SEQ ID NO: 657 - protein, 231 aa, Artificial Sequence; identical to SEQ ID NO: 48
  Description of Artificial Sequence: Synthetic polypeptide
  Fc Chain of XENP022635

SEQ ID NO: 658 - protein, 114 aa, Artificial Sequence; identical to SEQ ID NO: 105
  Description of Artificial Sequence: Synthetic polypeptide
  XENP022635 Chain 2 - human_IL15_E87C_no_tag (17074)

SEQ ID NO: 659 - protein, 296 aa, Artificial Sequence; identical to SEQ ID NO: 187
  Description of Artificial Sequence: Synthetic polypeptide
  XENP022636 Chain 1 - human_IL15Ralpha(Sushi-S40C)-Fc(216)_IgG1_ C220S/PVA_/S267K (17583)

SEQ ID NO: 660 - protein, 65 aa, Artificial Sequence; identical to SEQ ID NO: 116
  Description of Artificial Sequence: Synthetic polypeptide
  XENP022636 Human IL15Ralpha(Sushi)

SEQ ID NO: 661 - protein, 231 aa, Artificial Sequence; identical to SEQ ID NO: 48
  Description of Artificial Sequence: Synthetic polypeptide
  Fc Chain of XENP022636

SEQ ID NO: 662 - protein, 114 aa, Artificial Sequence; identical to SEQ ID NO: 107
  Description of Artificial Sequence: Synthetic polypeptide
  XENP022636 Chain 2 - human_IL15_L52C_no_tag (17072)

SEQ ID NO: 663 - protein, 306 aa, Artificial Sequence; identical to SEQ ID NO: 92
  Description of Artificial Sequence: Synthetic polypeptide
  XENP022637 Chain 1 - empty-Fc(216)_IgG1_pI(-)_Isosteric_A_ C220S/PVA_/S267K/L368D/K370S_(GGGGS)2_IL15Ralpha(Sushi) (17603)

SEQ ID NO: 664 - protein, 231 aa, Artificial Sequence; identical to SEQ ID NO: 27
  Description of Artificial Sequence: Synthetic polypeptide
  Fc Chain of XENP022637

SEQ ID NO: 665 - protein, 65 aa, Artificial Sequence; identical to SEQ ID NO: 4
  Description of Artificial Sequence: Synthetic polypeptide
  XENP022637 IL15Ralpha(Sushi)

SEQ ID NO: 666 - protein, 231 aa, Artificial Sequence; identical to SEQ ID NO: 51
  Description of Artificial Sequence: Synthetic polypeptide
  XENP022637 Chain 2 - empty-Fc(216)_IgG1_ISO(+RR)_C220S/PVA_ /S267K/S364K/E357Q (8927)

SEQ ID NO: 667 - protein, 114 aa, Artificial Sequence; identical to SEQ ID NO: 2
  Description of Artificial Sequence: Synthetic polypeptide
  XENP022637 Chain 3 - human_IL15_no_tag (16484)

SEQ ID NO: 668 - protein, 114 aa, Artificial Sequence; identical to SEQ ID NO: 2
  Description of Artificial Sequence: Synthetic polypeptide
  XENP022638 Chain 1 - IL15

SEQ ID NO: 669 - protein, 231 aa, Artificial Sequence; identical to SEQ ID NO: 27
  Description of Artificial Sequence: Synthetic polypeptide
  XENP022638 Chain 2 - empty_ Fc(216)_IgG1_pI(-)_Isosteric_A_ C220S/PVA_/S267K/L368D/K370S

SEQ ID NO: 670 - protein, 306 aa, Artificial Sequence
  Description of Artificial Sequence: Synthetic polypeptide
  XENP022638 Chain 3 - Fc(216)_ IgG1_ISO(+RR)_C220S/PVA_ /S267K/S364K/E357Q_(GGGGS)2_IL15Ralpha(Sushi)
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIR

SEQ ID NO: 671 - protein, 231 aa, Artificial Sequence; identical to SEQ ID NO: 51
  Description of Artificial Sequence: Synthetic polypeptide
  Fc Chain of XENP022638

SEQ ID NO: 672 - protein, 65 aa, Artificial Sequence; identical to SEQ ID NO: 4
  Description of Artificial Sequence: Synthetic polypeptide
  XENP022638 IL15Ralpha(Sushi)

SEQ ID NO: 673 - protein, 308 aa, Artificial Sequence; identical to SEQ ID NO: 191
  Description of Artificial Sequence: Synthetic polypeptide
  XENP022639 Chain 1 - empty-Fc(216)_IgG1_pI(-)_Isosteric_A_ C220S/PVA_/S267K/L368D/K370S_(GGGGS)2_IL15Ralpha(Sushi-D96 /C97) (17605)

SEQ ID NO: 674 - protein, 231 aa, Artificial Sequence; identical to SEQ ID NO: 27
  Description of Artificial Sequence: Synthetic polypeptide
  Fc Chain of XENP022639

SEQ ID NO: 675 - protein, 67 aa, Artificial Sequence; identical to SEQ ID NO: 113
  Description of Artificial Sequence: Synthetic polypeptide
  XENP022639 IL15Ralpha(Sushi)

SEQ ID NO: 676 - protein, 231 aa, Artificial Sequence; identical to SEQ ID NO: 51
  Description of Artificial Sequence: Synthetic polypeptide
  XENP022639 Chain 2 - empty-Fc(216)_IgG1_ISO(+RR)_C220S/PVA_ /S267K/S364K/E357Q (8927)

SEQ ID NO: 677 - protein, 114 aa, Artificial Sequence; identical to SEQ ID NO: 105
  Description of Artificial Sequence: Synthetic polypeptide
  XENP022639 Chain 3 - human_IL15_E87C_no_tag (17074)

SEQ ID NO: 678 - protein, 114 aa, Artificial Sequence; identical to SEQ ID NO: 105
  Description of Artificial Sequence: Synthetic polypeptide
  XENP022640 Chain 1 - IL15

SEQ ID NO: 679 - protein, 231 aa, Artificial Sequence; identical to SEQ ID NO: 27
  Description of Artificial Sequence: Synthetic polypeptide
  XENP022640 Chain 2 - empty_Fc(216)_IgG1_pI(-)_Isosteric_A_ C220S/PVA_/S267K/L368D/K370S

SEQ ID NO: 680 - protein, 114 aa, Artificial Sequence; identical to SEQ ID NO: 105
  Description of Artificial Sequence: Synthetic polypeptide
  XENP022684 Chain 1 - IL15_E87C

SEQ ID NO: 681 - protein, 299 aa, Artificial Sequence; identical to SEQ ID NO: 176
  Description of Artificial Sequence: Synthetic polypeptide
  XENP022684 Chain 2 - IL15Ralpha(Sushi-D96/C97/A98)_Fc(216)_ IgG1_pI(-)_Isosteric_A_C220S/PVA_/S267K/L368D/K370S

SEQ ID NO: 682 - protein, 68 aa, Artificial Sequence; identical to SEQ ID NO: 115
  Description of Artificial Sequence: Synthetic polypeptide
  XENP022684 IL15Ralpha(Sushi)

SEQ ID NO: 683 - protein, 231 aa, Artificial Sequence; identical to SEQ ID NO: 26
  Description of Artificial Sequence: Synthetic polypeptide
  Fc Chain of XENP022684

SEQ ID NO: 684 - protein, 231 aa, Artificial Sequence; identical to SEQ ID NO: 27
  Description of Artificial Sequence: Synthetic polypeptide
  XENP022684 Chain 3 - empty_Fc(216)_IgG1_C220S/PVA_ /S267K/S364K/E357Q

SEQ ID NO: 685 - protein, 114 aa, Artificial Sequence; identical to SEQ ID NO: 105
  Description of Artificial Sequence: Synthetic polypeptide
  XENP022687 Chain 1 - IL15_E87C

SEQ ID NO: 686 - protein, 299 aa, Artificial Sequence; identical to SEQ ID NO: 183
  Description of Artificial Sequence: Synthetic polypeptide
  XENP022687 Chain 2 - IL15Ralpha(Sushi-D96/C97/A98)_Fc(216)_ IgG1_C220S/PVA_/S267K

SEQ ID NO: 687 - protein, 68 aa, Artificial Sequence; identical to SEQ ID NO: 115
  Description of Artificial Sequence: Synthetic polypeptide
  XENP022687 IL15Ralpha(Sushi)

SEQ ID NO: 688 - protein, 231 aa, Artificial Sequence; identical to SEQ ID NO: 48
  Description of Artificial Sequence: Synthetic polypeptide
  Fc Chain of XENP022687

SEQ ID NO: 689 - protein, 114 aa, Artificial Sequence; identical to SEQ ID NO: 198
  Description of Artificial Sequence: Synthetic polypeptide
  XENP022791 Chain 1 - human_IL15_N1D(non-covalent) (17666)

SEQ ID NO: 690 - protein, 65 aa, Artificial Sequence; identical to SEQ ID NO: 4
  Description of Artificial Sequence: Synthetic polypeptide
  XENP022791 Chain 2 - human_IL15Ralpha(Sushi)-6x-His (17033)

SEQ ID NO: 691 - protein, 114 aa, Artificial Sequence; identical to SEQ ID NO: 199
  Description of Artificial Sequence: Synthetic polypeptide
  XENP022792 Chain 1 - human_IL15_N4D(non-covalent) (17667)

SEQ ID NO: 692 - protein, 65 aa, Artificial Sequence; identical to SEQ ID NO: 4
  Description of Artificial Sequence: Synthetic polypeptide
  XENP022792 Chain 2 - human_IL15Ralpha(Sushi)-6x-His (17033)

SEQ ID NO: 693 - protein, 114 aa, Artificial Sequence; identical to SEQ ID NO: 200
  Description of Artificial Sequence: Synthetic polypeptide
  XENP022793 Chain 1 - human_IL15_D8N(non-covalent) (17668)

SEQ ID NO: 694 - protein, 65 aa, Artificial Sequence; identical to SEQ ID NO: 4
  Description of Artificial Sequence: Synthetic polypeptide
  XENP022793 Chain 2 - human_IL15Ralpha(Sushi)-6x-His (17033)

SEQ ID NO: 695 - protein, 114 aa, Artificial Sequence; identical to SEQ ID NO: 201
  Description of Artificial Sequence: Synthetic polypeptide
  XENP022794 Chain 1 - human_IL15_D30N(non-covalent) (17669)

SEQ ID NO: 696 - protein, 65 aa, Artificial Sequence; identical to SEQ ID NO: 4
  Description of Artificial Sequence: Synthetic polypeptide
  XENP022794 Chain 2 - human_IL15Ralpha(Sushi)-6x-His (17033)

SEQ ID NO: 697 - protein, 114 aa, Artificial Sequence; identical to SEQ ID NO: 202
  Description of Artificial Sequence: Synthetic polypeptide
  XENP022795 Chain 1 - human_IL15_D61N(non-covalent) (17670)

SEQ ID NO: 698 - protein, 65 aa, Artificial Sequence; identical to SEQ ID NO: 4
  Description of Artificial Sequence: Synthetic polypeptide
  XENP022795 Chain 2 - human_IL15Ralpha(Sushi)-6x-His (17033)

SEQ ID NO: 699 - protein, 114 aa, Artificial Sequence; identical to SEQ ID NO: 203
  Description of Artificial Sequence: Synthetic polypeptide
  XENP022796 Chain 1 - human_IL15_E64Q(non-covalent) (17671)

SEQ ID NO: 700 - protein, 65 aa, Artificial Sequence; identical to SEQ ID NO: 4
  Description of Artificial Sequence: Synthetic polypeptide
  XENP022796 Chain 2 - human_IL15Ralpha(Sushi)-6x-His (17033)

SEQ ID NO: 701 - protein, 114 aa, Artificial Sequence; identical to SEQ ID NO: 204
  Description of Artificial Sequence: Synthetic polypeptide
  XENP022801 Chain 1 - human_IL15_N65D(non-covalent) (17672)

SEQ ID NO: 702 - protein, 65 aa, Artificial Sequence; identical to SEQ ID NO: 4
  Description of Artificial Sequence: Synthetic polypeptide
  XENP022801 Chain 2 - human_IL15Ralpha(Sushi)-6x-His (17033)

SEQ ID NO: 703 - protein, 114 aa, Artificial Sequence; identical to SEQ ID NO: 205
  Description of Artificial Sequence: Synthetic polypeptide
  XENP022802 Chain 1 - human_IL15_Q108E(non-covalent) (17673)

SEQ ID NO: 704 - protein, 65 aa, Artificial Sequence; identical to SEQ ID NO: 4
  Description of Artificial Sequence: Synthetic polypeptide
  XENP022802 Chain 2 - human_IL15Ralpha(Sushi)-6x-His (17033)

SEQ ID NO: 705 - protein, 114 aa, Artificial Sequence; identical to SEQ ID NO: 206
  Description of Artificial Sequence: Synthetic polypeptide
  XENP022803 Chain 1 - human_IL15_ N1D/D61N(non-covalent) (17674)

SEQ ID NO: 706 - protein, 65 aa, Artificial Sequence; identical to SEQ ID NO: 4
  Description of Artificial Sequence: Synthetic polypeptide
  XENP022803 Chain 2 - human_IL15Ralpha(Sushi)-6x-His (17033)

SEQ ID NO: 707 - protein, 114 aa, Artificial Sequence; identical to SEQ ID NO: 207
  Description of Artificial Sequence: Synthetic polypeptide
  XENP022804 Chain 1 - human_IL15_ N1D/E64Q(non-covalent) (17675)

SEQ ID NO: 708 - protein, 65 aa, Artificial Sequence; identical to SEQ ID NO: 4
  Description of Artificial Sequence: Synthetic polypeptide
  XENP022804 Chain 2 - human_IL15Ralpha(Sushi)-6x-His (17033)

SEQ ID NO: 709 - protein, 114 aa, Artificial Sequence; identical to SEQ ID NO: 208
  Description of Artificial Sequence: Synthetic polypeptide
  XENP022805 Chain 1 - human_IL15_ N4D/D61N(non-covalent) (17676)

SEQ ID NO: 710 - protein, 65 aa, Artificial Sequence; identical to SEQ ID NO: 4
  Description of Artificial Sequence: Synthetic polypeptide
  XENP022805 Chain 2 - human_IL15Ralpha(Sushi)-6x-His (17033)

SEQ ID NO: 711 - protein, 114 aa, Artificial Sequence; identical to SEQ ID NO: 209
  Description of Artificial Sequence: Synthetic polypeptide
  XENP022806 Chain 1 - human_IL15_ N4D/E64Q(non-covalent) (17677)

SEQ ID NO: 712 - protein, 65 aa, Artificial Sequence; identical to SEQ ID NO: 4
  Description of Artificial Sequence: Synthetic polypeptide
  XENP022806 Chain 2 - human_IL15Ralpha(Sushi)-6x-His (17033)

SEQ ID NO: 713 - protein, 114 aa, Artificial Sequence; identical to SEQ ID NO: 210
  Description of Artificial Sequence: Synthetic polypeptide
  XENP022807 Chain 1 - human_IL15_ D8N/D61N(non-covalent) (17678)

SEQ ID NO: 714 - protein, 65 aa, Artificial Sequence; identical to SEQ ID NO: 4
  Description of Artificial Sequence: Synthetic polypeptide
  XENP022807 Chain 2 - human_IL15Ralpha(Sushi)-6x-His (17033)

SEQ ID NO: 715 - protein, 114 aa, Artificial Sequence; identical to SEQ ID NO: 211
  Description of Artificial Sequence: Synthetic polypeptide
  XENP022808 Chain 1 - human_IL15_ D8N/E64Q(non-covalent) (17679)

SEQ ID NO: 716 - protein, 65 aa, Artificial Sequence; identical to SEQ ID NO: 4
  Description of Artificial Sequence: Synthetic polypeptide
  XENP022808 Chain 2 - human_IL15Ralpha(Sushi)-6x-His (17033)

SEQ ID NO: 717 - protein, 114 aa, Artificial Sequence; identical to SEQ ID NO: 212
  Description of Artificial Sequence: Synthetic polypeptide
  XENP022809 Chain 1 - human_IL15_ D61N/E64Q(non-covalent) (17680)

SEQ ID NO: 718 - protein, 65 aa, Artificial Sequence; identical to SEQ ID NO: 4
  Description of Artificial Sequence: Synthetic polypeptide
  XENP022809 Chain 2 - human_IL15Ralpha(Sushi)-6x-His (17033)

SEQ ID NO: 719 - protein, 114 aa, Artificial Sequence; identical to SEQ ID NO: 213
  Description of Artificial Sequence: Synthetic polypeptide
  XENP022810 Chain 1 - human_IL15_ E64Q/Q108E(non-covalent) (17681)

SEQ ID NO: 720 - protein, 65 aa, Artificial Sequence; identical to SEQ ID NO: 4
  Description of Artificial Sequence: Synthetic polypeptide
  XENP022810 Chain 2 - human_IL15Ralpha(Sushi)-6x-His (17033)

SEQ ID NO: 721 - protein, 114 aa, Artificial Sequence; identical to SEQ ID NO: 214
  Description of Artificial Sequence: Synthetic polypeptide
  XENP022811 Chain 1 - human_IL15_ N1D/N4D/D8N(non-covalent) (17682)

SEQ ID NO: 722 - protein, 65 aa, Artificial Sequence; identical to SEQ ID NO: 4
  Description of Artificial Sequence: Synthetic polypeptide
  XENP022811 Chain 2 - human_IL15Ralpha(Sushi)-6x-His (17033)

SEQ ID NO: 723 - protein, 114 aa, Artificial Sequence; identical to SEQ ID NO: 215
  Description of Artificial Sequence: Synthetic polypeptide
  XENP022812 Chain 1 - human_IL15_ D61N/E64Q/N65D(non-covalent) (17683)

SEQ ID NO: 724 - protein, 65 aa, Artificial Sequence; identical to SEQ ID NO: 4
  Description of Artificial Sequence: Synthetic polypeptide
  XENP022812 Chain 2 - human_IL15Ralpha(Sushi)-6x-His (17033)

SEQ ID NO: 725 - protein, 114 aa, Artificial Sequence; identical to SEQ ID NO: 216
  Description of Artificial Sequence: Synthetic polypeptide
  XENP022813 Chain 1 - human_IL15_ N1D/D61N/E64Q/Q108E(non-covalent) (17684)

SEQ ID NO: 726 - protein, 65 aa, Artificial Sequence; identical to SEQ ID NO: 4
  Description of Artificial Sequence: Synthetic polypeptide
  XENP022813 Chain 2 - human_IL15Ralpha(Sushi)-6x-His (17033)

SEQ ID NO: 727 - protein, 114 aa, Artificial Sequence; identical to SEQ ID NO: 217
  Description of Artificial Sequence: Synthetic polypeptide
  XENP022814 Chain 1 - human_IL15_ N4D/D61N/E64Q/Q108E(non-covalent) (17685)

SEQ ID NO: 728 - protein, 65 aa, Artificial Sequence; identical to SEQ ID NO: 4
  Description of Artificial Sequence: Synthetic polypeptide
  XENP022814 Chain 2 - human_IL15Ralpha(Sushi)-6x-His (17033)

SEQ ID NO: 729 - protein, 350 aa, Artificial Sequence
  Description of Artificial Sequence: Synthetic polypeptide
  XENP022815 Chain 1 - human_IL15_N1D_(GGGGS)1 (17686)
DWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 730 - protein, 114 aa, Artificial Sequence; identical to SEQ ID NO: 198
  Description of Artificial Sequence: Synthetic polypeptide
  XENP022815 Human IL15

SEQ ID NO: 731 - protein, 231 aa, Artificial Sequence; identical to SEQ ID NO: 27
  Description of Artificial Sequence: Synthetic polypeptide
  Fc Chain of XENP022815

SEQ ID NO: 732 - protein, 301 aa, Artificial Sequence; identical to SEQ ID NO: 55
  Description of Artificial Sequence: Synthetic polypeptide
  XENP022815 Chain 2 - human_IL15Ralpha(Sushi)_(GGGGS)1_Fc(216)_ IgG1_pI(-)_Isosteric_A_C220S/PVA_/S267K/L368D/K370S-Fc(216)_ IgG1_C220S/PVA_/S267K/S364K/E357Q (15908)

SEQ ID NO: 733 - protein, 65 aa, Artificial Sequence; identical to SEQ ID NO: 4
  Description of Artificial Sequence: Synthetic polypeptide
  XENP022815 Human IL15Ralpha(Sushi)

SEQ ID NO: 734 - protein, 231 aa, Artificial Sequence; identical to SEQ ID NO: 26
  Description of Artificial Sequence: Synthetic polypeptide
  Fc Chain of XENP022815

SEQ ID NO: 735 - protein, 350 aa, Artificial Sequence
  Description of Artificial Sequence: Synthetic polypeptide
  XENP022816 Chain 1 - human_IL15_N4D_(GGGGS)1 (17687)
NWVDVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 736 - protein, 114 aa, Artificial Sequence; identical to SEQ ID NO: 199
  Description of Artificial Sequence: Synthetic polypeptide
  XENP022816 Human IL15

SEQ ID NO: 737 - protein, 231 aa, Artificial Sequence; identical to SEQ ID NO: 27
  Description of Artificial Sequence: Synthetic polypeptide
  Fc Chain of XENP022816

SEQ ID NO: 738 - protein, 301 aa, Artificial Sequence; identical to SEQ ID NO: 55
  Description of Artificial Sequence: Synthetic polypeptide
  XENP022816 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 739 - protein, 65 aa, Artificial Sequence; identical to SEQ ID NO: 4
  Description of Artificial Sequence: Synthetic polypeptide
  XENP022816 Human IL15Ralpha(Sushi)

SEQ ID NO: 740 - protein, 231 aa, Artificial Sequence; identical to SEQ ID NO: 26
  Description of Artificial Sequence: Synthetic polypeptide
  Fc Chain of XENP022816

SEQ ID NO: 741 - protein, 350 aa, Artificial Sequence
  Description of Artificial Sequence: Synthetic polypeptide
  XENP022817 Chain 1 - human_IL15_D8N_(GGGGS)1 (17688)
NWVNVISNLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 742 - protein, 114 aa, Artificial Sequence; identical to SEQ ID NO: 200
  Description of Artificial Sequence: Synthetic polypeptide
  XENP022817 Human IL15

SEQ ID NO: 743 - protein, 231 aa, Artificial Sequence; identical to SEQ ID NO: 27
  Description of Artificial Sequence: Synthetic polypeptide
  Fc Chain of XENP022817

SEQ ID NO: 744 - protein, 301 aa, Artificial Sequence; identical to SEQ ID NO: 55
  Description of Artificial Sequence: Synthetic polypeptide
  XENP022817 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 745 - protein, 65 aa, Artificial Sequence; identical to SEQ ID NO: 4
  Description of Artificial Sequence: Synthetic polypeptide
  XENP022817 Human IL15Ralpha(Sushi)

SEQ ID NO: 746 - protein, 231 aa, Artificial Sequence; identical to SEQ ID NO: 26
  Description of Artificial Sequence: Synthetic polypeptide
  Fc Chain of XENP022817

SEQ ID NO: 747 - protein, 350 aa, Artificial Sequence
  Description of Artificial Sequence: Synthetic polypeptide
  XENP022818 Chain 1 - human_IL15_D30N_(GGGGS)1 (17689)
NWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 748 - protein, 114 aa, Artificial Sequence; identical to SEQ ID NO: 201
  Description of Artificial Sequence: Synthetic polypeptide
  XENP022818 Human IL15

SEQ ID NO: 749 - protein, 231 aa, Artificial Sequence; identical to SEQ ID NO: 27
  Description of Artificial Sequence: Synthetic polypeptide
  Fc Chain of XENP022818

SEQ ID NO: 750 - protein, 301 aa, Artificial Sequence; identical to SEQ ID NO: 55
  Description of Artificial Sequence: Synthetic polypeptide
  XENP022818 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 751 - protein, 65 aa, Artificial Sequence; identical to SEQ ID NO: 4
  Description of Artificial Sequence: Synthetic polypeptide
  XENP022818 Human IL15Ralpha(Sushi)

SEQ ID NO: 752 - protein, 231 aa, Artificial Sequence; identical to SEQ ID NO: 26
  Description of Artificial Sequence: Synthetic polypeptide
  Fc Chain of XENP022818

SEQ ID NO: 753 - protein, 350 aa, Artificial Sequence
  Description of Artificial Sequence: Synthetic polypeptide
  XENP022819 Chain 1 - human_IL15_D61N_(GGGGS)1 (17690)
NWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 754 - protein, 114 aa, Artificial Sequence; identical to SEQ ID NO: 202
  Description of Artificial Sequence: Synthetic polypeptide
  XENP022819 Human IL15

SEQ ID NO: 755 - protein, 231 aa, Artificial Sequence; identical to SEQ ID NO: 27
  Description of Artificial Sequence: Synthetic polypeptide
  Fc Chain of XENP022819

SEQ ID NO: 756 - protein, 301 aa, Artificial Sequence; identical to SEQ ID NO: 55
  Description of Artificial Sequence: Synthetic polypeptide
  XENP022819 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 757 - protein, 65 aa, Artificial Sequence; identical to SEQ ID NO: 4
  Description of Artificial Sequence: Synthetic polypeptide
  XENP022819 Human IL15Ralpha(Sushi)

SEQ ID NO: 758 - protein, 231 aa, Artificial Sequence; identical to SEQ ID NO: 26
  Description of Artificial Sequence: Synthetic polypeptide
  Fc Chain of XENP022819

SEQ ID NO: 759 - protein, 350 aa, Artificial Sequence
  Description of Artificial Sequence: Synthetic polypeptide
  XENP022820 Chain 1 - human_IL15_E64Q_(GGGGS)1 (17691)
NWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 760 - protein, 114 aa, Artificial Sequence; identical to SEQ ID NO: 203
  Description of Artificial Sequence: Synthetic polypeptide
  XENP022820 Human IL15

SEQ ID NO: 761 - protein, 231 aa, Artificial Sequence; identical to SEQ ID NO: 27
  Description of Artificial Sequence: Synthetic polypeptide
  Fc Chain of XENP022820

SEQ ID NO: 762 - protein, 301 aa, Artificial Sequence; identical to SEQ ID NO: 55
  Description of Artificial Sequence: Synthetic polypeptide
  XENP022820 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 763 - protein, 65 aa, Artificial Sequence; identical to SEQ ID NO: 4
  Description of Artificial Sequence: Synthetic polypeptide
  XENP022820 Human IL15Ralpha(Sushi)

SEQ ID NO: 764 - protein, 231 aa, Artificial Sequence; identical to SEQ ID NO: 26
  Description of Artificial Sequence: Synthetic polypeptide
  Fc Chain of XENP022820

SEQ ID NO: 765 - protein, 350 aa, Artificial Sequence; identical to SEQ ID NO: 228
  Description of Artificial Sequence: Synthetic polypeptide
  XENP022821 Chain 1 - human_IL15_N65D_(GGGGS)1 (17692)

SEQ ID NO: 766 - protein, 114 aa, Artificial Sequence; identical to SEQ ID NO: 204
  Description of Artificial Sequence: Synthetic polypeptide
  XENP022821 Human IL15

SEQ ID NO: 767 - protein, 231 aa, Artificial Sequence; identical to SEQ ID NO: 27
  Description of Artificial Sequence: Synthetic polypeptide
  Fc Chain of XENP022821

SEQ ID NO: 768 - protein, 301 aa, Artificial Sequence; identical to SEQ ID NO: 55
  Description of Artificial Sequence: Synthetic polypeptide
  XENP022821 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 769 - protein, 65 aa, Artificial Sequence; identical to SEQ ID NO: 4
  Description of Artificial Sequence: Synthetic polypeptide
  XENP022821 Human IL15Ralpha(Sushi)

SEQ ID NO: 770 - protein, 231 aa, Artificial Sequence; identical to SEQ ID NO: 26
  Description of Artificial Sequence: Synthetic polypeptide
  Fc Chain of XENP022821

SEQ ID NO: 771 - protein, 350 aa, Artificial Sequence; identical to SEQ ID NO: 234
  Description of Artificial Sequence: Synthetic polypeptide
  XENP022822 Chain 1 - human_IL15_Q108E_(GGGGS)1 (17693)

SEQ ID NO: 772 - protein, 114 aa, Artificial Sequence; identical to SEQ ID NO: 205
  Description of Artificial Sequence: Synthetic polypeptide
  XENP022822 Human IL15

SEQ ID NO: 773 - protein, 231 aa, Artificial Sequence; identical to SEQ ID NO: 27
  Description of Artificial Sequence: Synthetic polypeptide
  Fc Chain of XENP022822

SEQ ID NO: 774 - protein, 301 aa, Artificial Sequence; identical to SEQ ID NO: 55
  Description of Artificial Sequence: Synthetic polypeptide
  XENP022822 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 775 - protein, 65 aa, Artificial Sequence; identical to SEQ ID NO: 4
  Description of Artificial Sequence: Synthetic polypeptide
  XENP022822 Human IL15Ralpha(Sushi)

SEQ ID NO: 776 - protein, 231 aa, Artificial Sequence; identical to SEQ ID NO: 26
  Description of Artificial Sequence: Synthetic polypeptide
  Fc Chain of XENP022822

SEQ ID NO: 777 - protein, 350 aa, Artificial Sequence
  Description of Artificial Sequence: Synthetic polypeptide
  XENP022823 Chain 1 - human_IL15_N1D/D61N_(GGGGS)1 (17694)
DWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 778 - protein, 114 aa, Artificial Sequence; identical to SEQ ID NO: 206
  Description of Artificial Sequence: Synthetic polypeptide
  XENP022823 Human IL15

SEQ ID NO: 779 - protein, 231 aa, Artificial Sequence; identical to SEQ ID NO: 27
  Description of Artificial Sequence: Synthetic polypeptide
  Fc Chain of XENP022823

SEQ ID NO: 780 - protein, 301 aa, Artificial Sequence; identical to SEQ ID NO: 55
  Description of Artificial Sequence: Synthetic polypeptide
  XENP022823 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 781 - protein, 65 aa, Artificial Sequence; identical to SEQ ID NO: 4
  Description of Artificial Sequence: Synthetic polypeptide
  XENP022823 Human IL15Ralpha(Sushi)

SEQ ID NO: 782 - protein, 231 aa, Artificial Sequence; identical to SEQ ID NO: 26
  Description of Artificial Sequence: Synthetic polypeptide
  Fc Chain of XENP022823

SEQ ID NO: 783 - protein, 350 aa, Artificial Sequence
  Description of Artificial Sequence: Synthetic polypeptide
  XENP022824 Chain 1 - human_IL15_N1D/E64Q_(GGGGS)1 (17695)
DWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 784 - protein, 114 aa, Artificial Sequence; identical to SEQ ID NO: 207
  Description of Artificial Sequence: Synthetic polypeptide
  XENP022824 Human IL15

SEQ ID NO: 785 - protein, 231 aa, Artificial Sequence; identical to SEQ ID NO: 27
  Description of Artificial Sequence: Synthetic polypeptide
  Fc Chain of XENP022824

SEQ ID NO: 786 - protein, 301 aa, Artificial Sequence; identical to SEQ ID NO: 55
  Description of Artificial Sequence: Synthetic polypeptide
  XENP022824 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 787 - protein, 65 aa, Artificial Sequence; identical to SEQ ID NO: 4
  Description of Artificial Sequence: Synthetic polypeptide
  XENP022824 Human IL15Ralpha(Sushi)

SEQ ID NO: 788 - protein, 231 aa, Artificial Sequence; identical to SEQ ID NO: 26
  Description of Artificial Sequence: Synthetic polypeptide
  Fc Chain of XENP022824

SEQ ID NO: 789 - protein, 350 aa, Artificial Sequence
  Description of Artificial Sequence: Synthetic polypeptide
  XENP022825 Chain 1 - human_IL15_N4D/D61N_(GGGGS)1 (17696)
NWVDVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 790 - protein, 114 aa, Artificial Sequence; identical to SEQ ID NO: 208
  Description of Artificial Sequence: Synthetic polypeptide
  XENP022825 Human IL15

SEQ ID NO: 791 - protein, 231 aa, Artificial Sequence; identical to SEQ ID NO: 27
  Description of Artificial Sequence: Synthetic polypeptide
  Fc Chain of XENP022825

SEQ ID NO: 792 - protein, 301 aa, Artificial Sequence; identical to SEQ ID NO: 55
  Description of Artificial Sequence: Synthetic polypeptide
  XENP022825 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 793 - protein, 65 aa, Artificial Sequence; identical to SEQ ID NO: 4
  Description of Artificial Sequence: Synthetic polypeptide
  XENP022825 Human IL15Ralpha(Sushi)

SEQ ID NO: 794 - protein, 231 aa, Artificial Sequence; identical to SEQ ID NO: 26
  Description of Artificial Sequence: Synthetic polypeptide
  Fc Chain of XENP022825

SEQ ID NO: 795 - protein, 350 aa, Artificial Sequence
  Description of Artificial Sequence: Synthetic polypeptide
  XENP022826 Chain 1 - human_IL15_N4D/E64Q_(GGGGS)1 (17697)
NWVDVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 796 - protein, 114 aa, Artificial Sequence; identical to SEQ ID NO: 209
  Description of Artificial Sequence: Synthetic polypeptide
  XENP022826 Human IL15

SEQ ID NO: 797 - protein, 231 aa, Artificial Sequence; identical to SEQ ID NO: 27
  Description of Artificial Sequence: Synthetic polypeptide
  Fc Chain of XENP022826

SEQ ID NO: 798 - protein, 301 aa, Artificial Sequence; identical to SEQ ID NO: 55
  Description of Artificial Sequence: Synthetic polypeptide
  XENP022826 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 799 - protein, 65 aa, Artificial Sequence; identical to SEQ ID NO: 4
  Description of Artificial Sequence: Synthetic polypeptide
  XENP022826 Human IL15Ralpha(Sushi)

SEQ ID NO: 800 - protein, 231 aa, Artificial Sequence; identical to SEQ ID NO: 26
  Description of Artificial Sequence: Synthetic polypeptide
  Fc Chain of XENP022826

SEQ ID NO: 801 - protein, 350 aa, Artificial Sequence
  Description of Artificial Sequence: Synthetic polypeptide
  XENP022827 Chain 1 - human_IL15_D8N/D61N_(GGGGS)1 (17698)
NWVNVISNLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 802 - protein, 114 aa, Artificial Sequence; identical to SEQ ID NO: 210
  Description of Artificial Sequence: Synthetic polypeptide
  XENP022827 Human IL15

SEQ ID NO: 803 - protein, 231 aa, Artificial Sequence; identical to SEQ ID NO: 27
  Description of Artificial Sequence: Synthetic polypeptide
  Fc Chain of XENP022827

SEQ ID NO: 804 - protein, 301 aa, Artificial Sequence; identical to SEQ ID NO: 55
  Description of Artificial Sequence: Synthetic polypeptide
  XENP022827 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 805 - protein, 65 aa, Artificial Sequence; identical to SEQ ID NO: 4
  Description of Artificial Sequence: Synthetic polypeptide
  XENP022827 Human IL15Ralpha(Sushi)

SEQ ID NO: 806 - protein, 231 aa, Artificial Sequence; identical to SEQ ID NO: 26
  Description of Artificial Sequence: Synthetic polypeptide
  Fc Chain of XENP022827

SEQ ID NO: 807 - protein, 350 aa, Artificial Sequence
  Description of Artificial Sequence: Synthetic polypeptide
  XENP022828 Chain 1 - human_IL15_D8N/E64Q_(GGGGS)1 (17699)
NWVNVISNLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 808 - protein, 114 aa, Artificial Sequence; identical to SEQ ID NO: 211
  Description of Artificial Sequence: Synthetic polypeptide
  XENP022828 Human IL15

SEQ ID NO: 809 - protein, 231 aa, Artificial Sequence; identical to SEQ ID NO: 27
  Description of Artificial Sequence: Synthetic polypeptide
  Fc Chain of XENP022828

SEQ ID NO: 810 - protein, 301 aa, Artificial Sequence; identical to SEQ ID NO: 55
  Description of Artificial Sequence: Synthetic polypeptide
  XENP022828 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 811 - protein, 65 aa, Artificial Sequence; identical to SEQ ID NO: 4
  Description of Artificial Sequence: Synthetic polypeptide
  XENP022828 Human IL15Ralpha(Sushi)

SEQ ID NO: 812 - protein, 231 aa, Artificial Sequence; identical to SEQ ID NO: 26
  Description of Artificial Sequence: Synthetic polypeptide
  Fc Chain of XENP022828

SEQ ID NO: 813 - protein, 350 aa, Artificial Sequence
  Description of Artificial Sequence: Synthetic polypeptide
  XENP022829 Chain 1 - human_IL15_D61N/E64Q_(GGGGS)1 (17700)
NWVNVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 814 - protein, 114 aa, Artificial Sequence; identical to SEQ ID NO: 212
  Description of Artificial Sequence: Synthetic polypeptide
  XENP022829 Human IL15

SEQ ID NO: 815 - protein, 231 aa, Artificial Sequence; identical to SEQ ID NO: 27
  Description of Artificial Sequence: Synthetic polypeptide
  Fc Chain of XENP022829

SEQ ID NO: 816 - protein, 301 aa, Artificial Sequence; identical to SEQ ID NO: 55
  Description of Artificial Sequence: Synthetic polypeptide
  XENP022829 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 817 - protein, 65 aa, Artificial Sequence; identical to SEQ ID NO: 4
  Description of Artificial Sequence: Synthetic polypeptide
  XENP022829 Human IL15Ralpha(Sushi)

SEQ ID NO: 818 - protein, 231 aa, Artificial Sequence; identical to SEQ ID NO: 26
  Description of Artificial Sequence: Synthetic polypeptide
  Fc Chain of XENP022829

SEQ ID NO: 819 - protein, 350 aa, Artificial Sequence
  Description of Artificial Sequence: Synthetic polypeptide
  XENP022830 Chain 1 - human_IL15_E64Q/Q108E_(GGGGS)1 (17701)
NWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 820 - protein, 114 aa, Artificial Sequence; identical to SEQ ID NO: 213
  Description of Artificial Sequence: Synthetic polypeptide
  XENP022830 Human IL15

SEQ ID NO: 821 - protein, 231 aa, Artificial Sequence; identical to SEQ ID NO: 27
  Description of Artificial Sequence: Synthetic polypeptide
  Fc Chain of XENP022830

SEQ ID NO: 822 - protein, 301 aa, Artificial Sequence; identical to SEQ ID NO: 55
  Description of Artificial Sequence: Synthetic polypeptide
  XENP022830 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 823 - protein, 65 aa, Artificial Sequence; identical to SEQ ID NO: 4
  Description of Artificial Sequence: Synthetic polypeptide
  XENP022830 Human IL15Ralpha(Sushi)

SEQ ID NO: 824 - protein, 231 aa, Artificial Sequence; identical to SEQ ID NO: 26
  Description of Artificial Sequence: Synthetic polypeptide
  Fc Chain of XENP022830

SEQ ID NO: 825 - protein, 350 aa, Artificial Sequence
  Description of Artificial Sequence: Synthetic polypeptide
  XENP022831 Chain 1 - human_IL15_N1D/N4D/D8N_(GGGGS)1 (17702)
DWVDVISNLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 826 - protein, 114 aa, Artificial Sequence; identical to SEQ ID NO: 214
  Description of Artificial Sequence: Synthetic polypeptide
  XENP022831 Human IL15

SEQ ID NO: 827 - protein, 231 aa, Artificial Sequence; identical to SEQ ID NO: 27
  Description of Artificial Sequence: Synthetic polypeptide
  Fc Chain of XENP022831

SEQ ID NO: 828 - protein, 301 aa, Artificial Sequence; identical to SEQ ID NO: 55
  Description of Artificial Sequence: Synthetic polypeptide
  XENP022831 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 829 - protein, 65 aa, Artificial Sequence; identical to SEQ ID NO: 4
  Description of Artificial Sequence: Synthetic polypeptide
  XENP022831 Human IL15Ralpha(Sushi)

SEQ ID NO: 830 - protein, 231 aa, Artificial Sequence; identical to SEQ ID NO: 26
  Description of Artificial Sequence: Synthetic polypeptide
  Fc Chain of XENP022831

SEQ ID NO: 831 - protein, 350 aa, Artificial Sequence
  Description of Artificial Sequence: Synthetic polypeptide
  XENP022832 Chain 1 - human_IL15_D61N/E64Q/N65D_ (GGGGS)1 (17703)
NWVNVISDLKKIEDLIQSMHIDATLYTESDVHPSCKVTAMKCFLLELQVISLESGDASIHNTVQDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 832 - protein, 114 aa, Artificial Sequence; identical to SEQ ID NO: 215
  Description of Artificial Sequence: Synthetic polypeptide
  XENP022832 Human IL15

SEQ ID NO: 833 - protein, 231 aa, Artificial Sequence; identical to SEQ ID NO: 27
  Description of Artificial Sequence: Synthetic polypeptide
  Fc Chain of XENP022832

SEQ ID NO: 834 - protein, 301 aa, Artificial Sequence; identical to SEQ ID NO: 55
  Description of Artificial Sequence: Synthetic polypeptide
  XENP022832 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 835 - protein, 65 aa, Artificial Sequence; identical to SEQ ID NO: 4
  Description of Artificial Sequence: Synthetic polypeptide
  XENP022832 Human IL15Ralpha(Sushi)

SEQ ID NO: 836 - protein, 231 aa, Artificial Sequence; identical to SEQ ID NO: 26
  Description of Artificial Sequence: Synthetic polypeptide
  Fc Chain of XENP022832

SEQ ID NO: 837 - protein, 350 aa, Artificial Sequence
  Description of Artificial Sequence: Synthetic polypeptide
  XENP022833 Chain 1 - human_IL15_N1D/D61N/E64Q/Q108E_ (GGGGS)1 (17704)
DWVNVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 838 - protein, 114 aa, Artificial Sequence; identical to SEQ ID NO: 216
  Description of Artificial Sequence: Synthetic polypeptide
  XENP022833 Human IL15

SEQ ID NO: 839 - protein, 231 aa, Artificial Sequence; identical to SEQ ID NO: 27
  Description of Artificial Sequence: Synthetic polypeptide
  Fc Chain of XENP022833

SEQ ID NO: 840 - protein, 301 aa, Artificial Sequence; identical to SEQ ID NO: 55
  Description of Artificial Sequence: Synthetic polypeptide
  XENP022833 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 841 - protein, 65 aa, Artificial Sequence; identical to SEQ ID NO: 4
  Description of Artificial Sequence: Synthetic polypeptide
  XENP022833 Human IL15Ralpha(Sushi)

SEQ ID NO: 842 - protein, 231 aa, Artificial Sequence; identical to SEQ ID NO: 26
  Description of Artificial Sequence: Synthetic polypeptide
  Fc Chain of XENP022833

SEQ ID NO: 843 - protein, 350 aa, Artificial Sequence
  Description of Artificial Sequence: Synthetic polypeptide
  XENP022834 Chain 1 - human_IL15_N4D/D61N/E64Q/Q108E_ (GGGGS)1 (17705)
NWVDVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 844 - protein, 114 aa, Artificial Sequence; identical to SEQ ID NO: 217
  Description of Artificial Sequence: Synthetic polypeptide
  XENP022834 Human IL15

SEQ ID NO: 845 - protein, 231 aa, Artificial Sequence; identical to SEQ ID NO: 27
  Description of Artificial Sequence: Synthetic polypeptide
  Fc Chain of XENP022834

SEQ ID NO: 846 - protein, 301 aa, Artificial Sequence; identical to SEQ ID NO: 55
  Description of Artificial Sequence: Synthetic polypeptide
  XENP022834 Chain 2 - human_IL15Ralpha(Sushi)_(GGGGS)1_Fc(216)_ IgG1_pI(-)_Isosteric_A_C220S/PVA_/S267K/L368D/K370S- Fc(216)_IgG1_C220S/PVA_/S267K/S364K/E357Q (15908)

SEQ ID NO: 847 - protein, 65 aa, Artificial Sequence; identical to SEQ ID NO: 4
  Description of Artificial Sequence: Synthetic polypeptide
  XENP022834 Human IL15Ralpha(Sushi)

SEQ ID NO: 848 - protein, 231 aa, Artificial Sequence; identical to SEQ ID NO: 26
  Description of Artificial Sequence: Synthetic polypeptide
  Fc Chain of XENP022834

SEQ ID NO: 849 - protein, 440 aa, Artificial Sequence
  Description of Artificial Sequence: Synthetic polypeptide
  XENP023174 Chain 1 - human_IL15Ralpha(sushi)_(GKPGS)6-human_ IL15(single-chain)_Fc(216)_IgG1_pI(-)_Isosteric_ A_C220S/PVA_/S267K/L368D/K370S
ITCPPPMSVEHADIWVKSYSLYSRERYICNSGFKRKAGTSSLTECVLNKATNVAHWTTPSLKCIRGKPGSGKPGSGKPGSGKPGSGKPGSGKPGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 850 - protein, 65 aa, Artificial Sequence; identical to SEQ ID NO: 4
  Description of Artificial Sequence: Synthetic polypeptide
  XENP023174 Human IL15Ralpha(Sushi)

SEQ ID NO: 851 - protein, 114 aa, Artificial Sequence; identical to SEQ ID NO: 2
  Description of Artificial Sequence: Synthetic polypeptide
  XENP023174 Human IL15

SEQ ID NO: 852 - protein, 231 aa, Artificial Sequence; identical to SEQ ID NO: 27
  Description of Artificial Sequence: Synthetic polypeptide
  Fc Chain of XENP023174

SEQ ID NO: 853 - protein, 231 aa, Artificial Sequence; identical to SEQ ID NO: 26
  Description of Artificial Sequence: Synthetic polypeptide
  XENP023174 Chain 2 - empty_Fc(216)_IgG1_C220S/PVA_ /S267K/S364K/E357Q

SEQ ID NO: 854 - protein, 435 aa, Artificial Sequence
  Description of Artificial Sequence: Synthetic polypeptide
  XENP023175 Chain 1 - human_IL15Ralpha(sushi)_(GKPGS)5-human_ IL15(single-chain)_Fc(216)_IgG1_pI(-)_Isosteric_A_ C220S/PVA_/S267K/L368D/K370S
ITCPPPMSVEHADIWVKSYSLYSRERYICNSGFKRKAGTSSLTECVLNKATNVAHWTTPSLKCIRGKPGSGKPGSGKPGSGKPGSGKPGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 855 - protein, 65 aa, Artificial Sequence; identical to SEQ ID NO: 4
  Description of Artificial Sequence: Synthetic polypeptide
  XENP023175 Human IL15Ralpha(Sushi)

SEQ ID NO: 856 - protein, 114 aa, Artificial Sequence; identical to SEQ ID NO: 2
  Description of Artificial Sequence: Synthetic polypeptide
  XENP023175 Human IL15

SEQ ID NO: 857 - protein, 231 aa, Artificial Sequence; identical to SEQ ID NO: 27
  Description of Artificial Sequence: Synthetic polypeptide
  Fc Chain of XENP023175

SEQ ID NO: 858 - protein, 231 aa, Artificial Sequence; identical to SEQ ID NO: 26
  Description of Artificial Sequence: Synthetic polypeptide
  XENP023175 Chain 2 - empty_Fc(216)_IgG1_C220S/PVA_ /S267K/S364K/E357Q

SEQ ID NO: 859 - protein, 350 aa, Artificial Sequence; identical to SEQ ID NO: 358
  Description of Artificial Sequence: Synthetic polypeptide
  XENP023343 Chain 1 - human_IL15_N65D_(GGGGS)1_Fc(216)_IgG1_ pI(-)_Isosteric_A_C220S/PVA_/S267K/L368D/K370S/M428L/N434S (18295)

SEQ ID NO: 860 - protein, 114 aa, Artificial Sequence; identical to SEQ ID NO: 204
  Description of Artificial Sequence: Synthetic polypeptide
  XENP023343 Human IL15

SEQ ID NO: 861 - protein, 231 aa, Artificial Sequence; identical to SEQ ID NO: 47
  Description of Artificial Sequence: Synthetic polypeptide
  Fc Chain of XENP023343

SEQ ID NO: 862 - protein, 301 aa, Artificial Sequence; identical to SEQ ID NO: 361
  Description of Artificial Sequence: Synthetic polypeptide
  XENP023343 Chain 2 - human_IL15Ralpha(Sushi)_(GGGGS)1_Fc(216)_ IgG1_C220S/PVA_/S267K/S364K/E357Q/M428L/N434S (17761)

SEQ ID NO: 863 - protein, 65 aa, Artificial Sequence; identical to SEQ ID NO: 4
  Description of Artificial Sequence: Synthetic polypeptide
  XENP023343 Human IL15Ralpha(Sushi)

SEQ ID NO: 864 - protein, 231 aa, Artificial Sequence; identical to SEQ ID NO: 46
  Description of Artificial Sequence: Synthetic polypeptide
  Fc Chain of XENP023343

SEQ ID NO: 865 - protein, 231 aa, Artificial Sequence; identical to SEQ ID NO: 27
  Description of Artificial Sequence: Synthetic polypeptide
  XENP023472 Chain 1 - empty_ Fc(216)_IgG1_pI(-)_Isosteric_A_ C220S/PVA_/S267K/L368D/K370S

SEQ ID NO: 866 - protein, 114 aa, Artificial Sequence; identical to SEQ ID NO: 349
  Description of Artificial Sequence: Synthetic polypeptide
  XENP023472 Chain 2 - IL15_N65D/E87C

SEQ ID NO: 867 - protein, 298 aa, Artificial Sequence; identical to SEQ ID NO: 350
  Description of Artificial Sequence: Synthetic polypeptide
  XENP023472 Chain 3 - IL15Ralpha(Sushi-D96/C97)_Fc(216)_IgG1_ C220S/PVA_/S267K/S364K/E357Q

SEQ ID NO: 868 - protein, 67 aa, Artificial Sequence; identical to SEQ ID NO: 113
  Description of Artificial Sequence: Synthetic polypeptide
  XENP023472 IL15Ralpha(Sushi)

SEQ ID NO: 869 - protein, 231 aa, Artificial Sequence; identical to SEQ ID NO: 26
  Description of Artificial Sequence: Synthetic polypeptide
  Fc Chain of XENP023472

SEQ ID NO: 870 - protein, 231 aa, Artificial Sequence; identical to SEQ ID NO: 27
  Description of Artificial Sequence: Synthetic polypeptide
  XENP023473 Chain 1 - empty_ Fc(216)_IgG1_pI(-)_Isosteric_A_ C220S/PVA_/S267K/L368D/K370S

SEQ ID NO: 871 - protein, 114 aa, Artificial Sequence; identical to SEQ ID NO: 354
  Description of Artificial Sequence: Synthetic polypeptide
  XENP023473 Chain 2 - IL15_N65D/L52C

SEQ ID NO: 872 - protein, 296 aa, Artificial Sequence; identical to SEQ ID NO: 355
  Description of Artificial Sequence: Synthetic polypeptide
  XENP023473 Chain 3 - IL15Ralpha(Sushi-S40C)_Fc(216)_IgG1_ C220S/PVA_/S267K/S364K/E357Q

SEQ ID NO: 873 - protein, 65 aa, Artificial Sequence; identical to SEQ ID NO: 116
  Description of Artificial Sequence: Synthetic polypeptide
  XENP023473 IL15Ralpha(Sushi)

SEQ ID NO: 874 - protein, 231 aa, Artificial Sequence; identical to SEQ ID NO: 26
  Description of Artificial Sequence: Synthetic polypeptide
  Fc Chain of XENP023473

SEQ ID NO: 875 - protein, 350 aa, Artificial Sequence; identical to SEQ ID NO: 364
  Description of Artificial Sequence: Synthetic polypeptide
  XENP023504 Chain 1 - human_IL15_Q108E_(GGGGS)1_Fc(216)_IgG1_ pI(-)_Isosteric_A_C220S/PVA_/S267K/L368D/K370S/M428L/N434S

SEQ ID NO: 876 - protein, 114 aa, Artificial Sequence; identical to SEQ ID NO: 205
  Description of Artificial Sequence: Synthetic polypeptide
  XENP023504 Human IL15

SEQ ID NO: 877 - protein, 231 aa, Artificial Sequence; identical to SEQ ID NO: 47
  Description of Artificial Sequence: Synthetic polypeptide
  Fc Chain of XENP023504

SEQ ID NO: 878 - protein, 301 aa, Artificial Sequence; identical to SEQ ID NO: 361
  Description of Artificial Sequence: Synthetic polypeptide
  XENP023504 Chain 2 - human_IL15Ralpha(Sushi)_(GGGGS)1_ Fc(216)_ IgG1_C220S/PVA_/S267K/S364K/E357Q/M428L/N434S

SEQ ID NO: 879 - protein, 65 aa, Artificial Sequence; identical to SEQ ID NO: 4
  Description of Artificial Sequence: Synthetic polypeptide
  XENP023504 Human IL15Ralpha(Sushi)

SEQ ID NO: 880 - protein, 231 aa, Artificial Sequence; identical to SEQ ID NO: 46
  Description of Artificial Sequence: Synthetic polypeptide
  Fc Chain of XENP023504

SEQ ID NO: 881 - protein, 350 aa, Artificial Sequence; identical to SEQ ID NO: 240
  Description of Artificial Sequence: Synthetic polypeptide
  XENP023554 Chain 1 - human_IL15_N1D/N65D_(GGGGS)1_Fc(216)_IgG1_ pI(-)_Isosteric_A_C220S/PVA_/S267K/L368D/K370S (18783)

SEQ ID NO: 882 - protein, 114 aa, Artificial Sequence; identical to SEQ ID NO: 218
  Description of Artificial Sequence: Synthetic polypeptide
  XENP023554 Human IL15

SEQ ID NO: 883 - protein, 231 aa, Artificial Sequence; identical to SEQ ID NO: 27
  Description of Artificial Sequence: Synthetic polypeptide
  Fc Chain of XENP023554

SEQ ID NO: 884 - protein, 301 aa, Artificial Sequence; identical to SEQ ID NO: 55
  Description of Artificial Sequence: Synthetic polypeptide
  XENP023554 Chain 2 - human_IL15Ralpha(Sushi)_(GGGGS)1_Fc(216)_ IgG1_C220S/PVA_/S267K/S364K/E357Q (15908)

SEQ ID NO: 885 - protein, 65 aa, Artificial Sequence; identical to SEQ ID NO: 4
  Description of Artificial Sequence: Synthetic polypeptide
  XENP023554 Human IL15Ralpha(Sushi)

SEQ ID NO: 886 - protein, 231 aa, Artificial Sequence; identical to SEQ ID NO: 26
  Description of Artificial Sequence: Synthetic polypeptide
  Fc Chain of XENP023554

SEQ ID NO: 887 - protein, 350 aa, Artificial Sequence
  Description of Artificial Sequence: Synthetic polypeptide
  XENP023555 Chain 1 - human_IL15_N1D/Q108E_(GGGGS)1_Fc(216)_ IgG1_pI(-)_Isosteric_A_C220S/PVA_/S267K/L368D/K370S (18784)
DWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 888 - protein, 114 aa, Artificial Sequence; identical to SEQ ID NO: 219
  Description of Artificial Sequence: Synthetic polypeptide
  XENP023555 Human IL15

SEQ ID NO: 889 - protein, 231 aa, Artificial Sequence; identical to SEQ ID NO: 27
  Description of Artificial Sequence: Synthetic polypeptide
  Fc Chain of XENP023555

SEQ ID NO: 890 - protein, 301 aa, Artificial Sequence; identical to SEQ ID NO: 55
  Description of Artificial Sequence: Synthetic polypeptide
  XENP023555 Chain 2 - human_IL15Ralpha(Sushi)_(GGGGS)1_Fc(216)_ IgG1_C220S/PVA_/S267K/S364K/E357Q (15908)

SEQ ID NO: 891 - protein, 65 aa, Artificial Sequence; identical to SEQ ID NO: 4
  Description of Artificial Sequence: Synthetic polypeptide
  XENP023555 Human IL15Ralpha(Sushi)

SEQ ID NO: 892 - protein, 231 aa, Artificial Sequence; identical to SEQ ID NO: 26
  Description of Artificial Sequence: Synthetic polypeptide
  Fc Chain of XENP023555

SEQ ID NO: 893 - protein, 350 aa, Artificial Sequence; identical to SEQ ID NO: 246
  Description of Artificial Sequence: Synthetic polypeptide
  XENP023557 Chain 1 - human_IL15_N4D/N65D_(GGGGS)1_Fc(216)_IgG1_ pI(-)_Isosteric_A_C220S/PVA_/S267K/L368D/K370S (18786)

SEQ ID NO: 894 - protein, 114 aa, Artificial Sequence; identical to SEQ ID NO: 220
  Description of Artificial Sequence: Synthetic polypeptide
  XENP023557 Human IL15

SEQ ID NO: 895 - protein, 231 aa, Artificial Sequence; identical to SEQ ID NO: 27
  Description of Artificial Sequence: Synthetic polypeptide
  Fc Chain of XENP023557

SEQ ID NO: 896 - protein, 301 aa, Artificial Sequence; identical to SEQ ID NO: 55
  Description of Artificial Sequence: Synthetic polypeptide
  XENP023557 Chain 2 - human_IL15Ralpha(Sushi)_(GGGGS)1_Fc(216)_ IgG1_C220S/PVA_/S267K/S364K/E357Q (15908)

SEQ ID NO: 897 - protein, 65 aa, Artificial Sequence; identical to SEQ ID NO: 4
  Description of Artificial Sequence: Synthetic polypeptide
  XENP023557 Human IL15Ralpha(Sushi)

SEQ ID NO: 898 - protein, 231 aa, Artificial Sequence; identical to SEQ ID NO: 26
  Description of Artificial Sequence: Synthetic polypeptide
  Fc Chain of XENP023557

SEQ ID NO: 899 - protein, 350 aa, Artificial Sequence
  Description of Artificial Sequence: Synthetic polypeptide
  XENP023559 Chain 1 - human_IL15_D30N/N65D_(GGGGS)1_Fc(216)_ IgG1_pI(-)_Isosteric_A_C220S/PVA_/S267K/L368D/K370S (18788)
NWVNVISDLKKIEDLIQSMHIDATLYTESNVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 900 - protein, 114 aa, Artificial Sequence; identical to SEQ ID NO: 221
  Description of Artificial Sequence: Synthetic polypeptide
  XENP023559 Human IL15

SEQ ID NO: 901 - protein, 231 aa, Artificial Sequence; identical to SEQ ID NO: 27
  Description of Artificial Sequence: Synthetic polypeptide
  Fc Chain of XENP023559

SEQ ID NO: 902 - protein, 301 aa, Artificial Sequence; identical to SEQ ID NO: 55
  Description of Artificial Sequence: Synthetic polypeptide
  XENP023559 Chain 2 - human_IL15Ralpha(Sushi)_(GGGGS)1_Fc(216)_ IgG1_C220S/PVA_/S267K/S364K/E357Q (15908)

SEQ ID NO: 903 - protein, 65 aa, Artificial Sequence; identical to SEQ ID NO: 4
  Description of Artificial Sequence: Synthetic polypeptide
  XENP023559 Human IL15Ralpha(Sushi)

SEQ ID NO: 904 - protein, 231 aa, Artificial Sequence; identical to SEQ ID NO: 26
  Description of Artificial Sequence: Synthetic polypeptide
  Fc Chain of XENP023559

SEQ ID NO: 905 - protein, 350 aa, Artificial Sequence
  Description of Artificial Sequence: Synthetic polypeptide
  XENP023560 Chain 1 - human_IL15_D30N/Q108E_(GGGGS)1_Fc(216)_ IgG1_pI(-)_Isosteric_A_C220S/PVA_/S267K/L368D/K370S
NWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 906 - protein, 114 aa, Artificial Sequence; identical to SEQ ID NO: 222
  Description of Artificial Sequence: Synthetic polypeptide
  XENP023560 Human IL15

SEQ ID NO: 907 - protein, 231 aa, Artificial Sequence; identical to SEQ ID NO: 27
  Description of Artificial Sequence: Synthetic polypeptide
  Fc Chain of XENP023560

SEQ ID NO: 908 - protein, 301 aa, Artificial Sequence; identical to SEQ ID NO: 55
  Description of Artificial Sequence: Synthetic polypeptide
  XENP023560 Chain 2 - human_IL15Ralpha(Sushi)_(GGGGS)1_Fc(216)_ IgG1_C220S/PVA_/S267K/S364K/E357Q

SEQ ID NO: 909 - protein, 65 aa, Artificial Sequence; identical to SEQ ID NO: 4
  Description of Artificial Sequence: Synthetic polypeptide
  XENP023560 Human IL15Ralpha(Sushi)

SEQ ID NO: 910 - protein, 231 aa, Artificial Sequence; identical to SEQ ID NO: 26
  Description of Artificial Sequence: Synthetic polypeptide
  Fc Chain of XENP023560

SEQ ID NO: 911 - protein, 350 aa, Artificial Sequence; identical to SEQ ID NO: 252
  Description of Artificial Sequence: Synthetic polypeptide
  XENP023561 Chain 1 - human_IL15_N65D/Q108E_(GGGGS)1_Fc(216)_ IgG1_pI(-)_Isosteric_A_C220S/PVA_/S267K/L368D/K370S

SEQ ID NO: 912 - protein, 114 aa, Artificial Sequence; identical to SEQ ID NO: 223
  Description of Artificial Sequence: Synthetic polypeptide
  XENP023561 Human IL15

SEQ ID NO: 913 - protein, 231 aa, Artificial Sequence; identical to SEQ ID NO: 27
  Description of Artificial Sequence: Synthetic polypeptide
  Fc Chain of XENP023561

SEQ ID NO: 914 - protein, 301 aa, Artificial Sequence; identical to SEQ ID NO: 55
  Description of Artificial Sequence: Synthetic polypeptide
  XENP023561 Chain 2 - human_IL15Ralpha(Sushi)_(GGGGS)1_Fc(216)_ IgG1_C220S/PVA_/S267K/S364K/E357Q

SEQ ID NO: 915 - protein, 65 aa, Artificial Sequence; identical to SEQ ID NO: 4
  Description of Artificial Sequence: Synthetic polypeptide
  XENP023561 Human IL15Ralpha(Sushi)

SEQ ID NO: 916 - protein, 231 aa, Artificial Sequence; identical to SEQ ID NO: 26
  Description of Artificial Sequence: Synthetic polypeptide
  Fc Chain of XENP023561

SEQ ID NO: 917 - protein, 435 aa, Artificial Sequence
  Description of Artificial Sequence: Synthetic polypeptide
  XENP024013 Chain 1 - human_IL15Ralpha(sushi)_(GGGGS)5-human_ IL15(D61N single-chain)_Fc(216)_IgG1_pI(-)_Isosteric_A_ C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 918 - protein, 65 aa, Artificial Sequence; identical to SEQ ID NO: 4
  Description of Artificial Sequence: Synthetic polypeptide
  XENP024013 Human IL15Ralpha(Sushi)

SEQ ID NO: 919 - protein, 114 aa, Artificial Sequence; identical to SEQ ID NO: 202
  Description of Artificial Sequence: Synthetic polypeptide
  XENP024013 Human IL15

SEQ ID NO: 920 - protein, 231 aa, Artificial Sequence; identical to SEQ ID NO: 27
  Description of Artificial Sequence: Synthetic polypeptide
  Fc Chain of XENP024013

SEQ ID NO: 921 - protein, 231 aa, Artificial Sequence; identical to SEQ ID NO: 26
  Description of Artificial Sequence: Synthetic polypeptide
  XENP024013 Chain 2 - empty_ Fc(216)_IgG1_C220S/PVA_ /S267K/S364K/E357Q

SEQ ID NO: 922 - protein, 435 aa, Artificial Sequence
  Description of Artificial Sequence: Synthetic polypeptide
  XENP024014 Chain 1 - human_IL15Ralpha(sushi)_(GGGGS)5-human_ IL15(N65D single-chain) _Fc(216)_IgG1_pI(-)_Isosteric_A_ C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 923 - protein, 65 aa, Artificial Sequence; identical to SEQ ID NO: 4
  Description of Artificial Sequence: Synthetic polypeptide
  XENP024014 Human IL15Ralpha(Sushi)

SEQ ID NO: 924 - protein, 114 aa, Artificial Sequence; identical to SEQ ID NO: 204
  Description of Artificial Sequence: Synthetic polypeptide
  XENP024014 Human IL15

SEQ ID NO: 925 - protein, 231 aa, Artificial Sequence; identical to SEQ ID NO: 27
  Description of Artificial Sequence: Synthetic polypeptide
  Fc Chain of XENP024014

SEQ ID NO: 926 - protein, 231 aa, Artificial Sequence; identical to SEQ ID NO: 26
  Description of Artificial Sequence: Synthetic polypeptide
  XENP024014 Chain 2 - empty_ Fc(216)_IgG1_C220S/PVA_ /S267K/S364K/E357Q

SEQ ID NO: 927 - protein, 435 aa, Artificial Sequence; identical to SEQ ID NO: 288
  Description of Artificial Sequence: Synthetic polypeptide
  XENP024015 Chain 1 - human_IL15Ralpha(sushi)_(GGGGS)5-human_ IL15(Q108E single-chain) _Fc(216)_IgG1_pI(-)_Isosteric_A_ C220S/PVA_/S267K/L368D/K370S

SEQ ID NO: 928 - protein, 65 aa, Artificial Sequence; identical to SEQ ID NO: 4
  Description of Artificial Sequence: Synthetic polypeptide
  XENP024015 Human IL15Ralpha(Sushi)

SEQ ID NO: 929 - protein, 114 aa, Artificial Sequence; identical to SEQ ID NO: 205
  Description of Artificial Sequence: Synthetic polypeptide
  XENP024015 Human IL15

SEQ ID NO: 930 - protein, 231 aa, Artificial Sequence; identical to SEQ ID NO: 27
  Description of Artificial Sequence: Synthetic polypeptide
  Fc Chain of XENP024015

SEQ ID NO: 931 - protein, 231 aa, Artificial Sequence; identical to SEQ ID NO: 26
  Description of Artificial Sequence: Synthetic polypeptide
  XENP024015 Chain 2 - empty_Fc(216)_IgG1_C220S/PVA_ /S267K/S364K/E357Q

SEQ ID NO: 932 - protein, 435 aa, Artificial Sequence
  Description of Artificial Sequence: Synthetic polypeptide
  XENP024016 Chain 1 - human_IL15Ralpha(sushi)_(GGGGS)5-human_ IL15(N1D/D61N single-chain) _Fc(216)_IgG1_pI(-)_Isosteric_A_ C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSDWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 933 - protein, 65 aa, Artificial Sequence; identical to SEQ ID NO: 4
  Description of Artificial Sequence: Synthetic polypeptide
  XENP024016 Human IL15Ralpha(Sushi)

SEQ ID NO: 934 - protein, 114 aa, Artificial Sequence; identical to SEQ ID NO: 206
  Description of Artificial Sequence: Synthetic polypeptide
  XENP024016 Human IL15

SEQ ID NO: 935 - protein, 231 aa, Artificial Sequence; identical to SEQ ID NO: 27
  Description of Artificial Sequence: Synthetic polypeptide
  Fc Chain of XENP024016

SEQ ID NO: 936 - protein, 231 aa, Artificial Sequence; identical to SEQ ID NO: 26
  Description of Artificial Sequence: Synthetic polypeptide
  XENP024016 Chain 2 - empty_ Fc(216)_IgG1_C220S/PVA_ /S267K/S364K/E357Q

SEQ ID NO: 937 - protein, 345 aa, Artificial Sequence
  Description of Artificial Sequence: Synthetic polypeptide
  XENP024017 Chain 1 - human_IL15(D61N)_Fc(216)_IgG1_pI(-)_ Isosteric_A_C220S/PVA_/S267K/L368D/K370S
NWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 938 - protein, 114 aa, Artificial Sequence; identical to SEQ ID NO: 202
  Description of Artificial Sequence: Synthetic polypeptide
  XENP024017 Human IL15

SEQ ID NO: 939 - protein, 231 aa, Artificial Sequence; identical to SEQ ID NO: 27
  Description of Artificial Sequence: Synthetic polypeptide
  Fc Chain of XENP024017

SEQ ID NO: 940 - protein, 296 aa, Artificial Sequence; identical to SEQ ID NO: 61
  Description of Artificial Sequence: Synthetic polypeptide
  XENP024017 Chain 2 - human_IL15Ralpha(Sushi)_Fc(216)_IgG1_ C220S/PVA_/S267K/S364K/E357Q

SEQ ID NO: 941 - protein, 65 aa, Artificial Sequence; identical to SEQ ID NO: 4
  Description of Artificial Sequence: Synthetic polypeptide
  XENP024017 Human IL15Ralpha(Sushi)

SEQ ID NO: 942 - protein, 231 aa, Artificial Sequence; identical to SEQ ID NO: 26
  Description of Artificial Sequence: Synthetic polypeptide
  Fc Chain of XENP024017

SEQ ID NO: 943 - protein, 345 aa, Artificial Sequence; identical to SEQ ID NO: 258
  Description of Artificial Sequence: Synthetic polypeptide
  XENP024018 Chain 1 - human_IL15(N65D)_Fc(216)_IgG1_pI(-)_ Isosteric_A_C220S/PVA_/S267K/L368D/K370S

SEQ ID NO: 944 - protein, 114 aa, Artificial Sequence; identical to SEQ ID NO: 204
  Description of Artificial Sequence: Synthetic polypeptide
  XENP024018 Human IL15

SEQ ID NO: 945 - protein, 231 aa, Artificial Sequence; identical to SEQ ID NO: 27
  Description of Artificial Sequence: Synthetic polypeptide
  Fc Chain of XENP024018

SEQ ID NO: 946 - protein, 296 aa, Artificial Sequence; identical to SEQ ID NO: 61
  Description of Artificial Sequence: Synthetic polypeptide
  XENP024018 Chain 2 - human_IL15Ralpha(Sushi)_Fc(216)_IgG1_ C220S/PVA_/S267K/S364K/E357Q

SEQ ID NO: 947 - protein, 65 aa, Artificial Sequence; identical to SEQ ID NO: 4
  Description of Artificial Sequence: Synthetic polypeptide
  XENP024018 Human IL15Ralpha(Sushi)

SEQ ID NO: 948 - protein, 231 aa, Artificial Sequence; identical to SEQ ID NO: 26
  Description of Artificial Sequence: Synthetic polypeptide
  Fc Chain of XENP024018

SEQ ID NO: 949 - protein, 345 aa, Artificial Sequence; identical to SEQ ID NO: 264
  Description of Artificial Sequence: Synthetic polypeptide
  XENP024019 Chain 1 - human_IL15(Q108E)-human_IL15Ralpha(Sushi)_ Fc(216)_IgG1_pI(-)_Isosteric_A_C220S/PVA_/S267K/L368D/K370S (19242)

SEQ ID NO: 950 - protein, 114 aa, Artificial Sequence; identical to SEQ ID NO: 205
  Description of Artificial Sequence: Synthetic polypeptide
  XENP024019 Human IL15

SEQ ID NO: 951 - protein, 231 aa, Artificial Sequence; identical to SEQ ID NO: 27
  Description of Artificial Sequence: Synthetic polypeptide
  XENP024019 IL-15/Ralpha-Fc monomer 2 of IL-15/Ralpha-Fc Backbone 1

SEQ ID NO: 952 - protein, 296 aa, Artificial Sequence; identical to SEQ ID NO: 61
  Description of Artificial Sequence: Synthetic polypeptide
  XENP024019 Chain 2 - human_IL15Ralpha(Sushi)_Fc(216)_IgG1_ C220S/PVA_/S267K/S364K/E357Q (16481)

SEQ ID NO: 953 - protein, 65 aa, Artificial Sequence; identical to SEQ ID NO: 4
  Description of Artificial Sequence: Synthetic polypeptide
  XENP024019 Human IL15Ralpha(Sushi)

SEQ ID NO: 954 - protein, 231 aa, Artificial Sequence; identical to SEQ ID NO: 26
  Description of Artificial Sequence: Synthetic polypeptide
  Fc Chain of XENP024019

SEQ ID NO: 955 - protein, 345 aa, Artificial Sequence
  Description of Artificial Sequence: Synthetic polypeptide
  XENP024020 Chain 1 - human_IL15(N1D/D61N)_Fc(216)_IgG1_pI(-)_ Isosteric_A_C220S/PVA_/S267K/L368D/K370S (19243)
DWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 956 - protein, 114 aa, Artificial Sequence; identical to SEQ ID NO: 206
  Description of Artificial Sequence: Synthetic polypeptide
  XENP024020 Human IL15

SEQ ID NO: 957 - protein, 231 aa, Artificial Sequence; identical to SEQ ID NO: 27
  Description of Artificial Sequence: Synthetic polypeptide
  Fc Chain of XENP024020

SEQ ID NO: 958 - protein, 296 aa, Artificial Sequence; identical to SEQ ID NO: 61
  Description of Artificial Sequence: Synthetic polypeptide
  XENP024020 Chain 2 - human_IL15Ralpha(Sushi)_Fc(216)_IgG1_ C220S/PVA_/S267K/S364K/E357Q (16481)

SEQ ID NO: 959 - protein, 65 aa, Artificial Sequence; identical to SEQ ID NO: 4
  Description of Artificial Sequence: Synthetic polypeptide
  XENP024020 Human IL15Ralpha(Sushi)

SEQ ID NO: 960 - protein, 231 aa, Artificial Sequence; identical to SEQ ID NO: 26
  Description of Artificial Sequence: Synthetic polypeptide
  Fc Chain of XENP024020

SEQ ID NO: 961 - protein, 350 aa, Artificial Sequence
  Description of Artificial Sequence: Synthetic polypeptide
  XENP024043 Chain 1 - human_IL15_E64Q/N65D_(GGGGS)1_Fc(216)_ IgG1_pI(-)_Isosteric_A_C220S/PVA_/S267K/L368D/K370S
NWVNVISDLKKIEDLIQSMHIDATLYTESDVHPSCKVTAMKCFLLELQVISLESGDASIHDTVQDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 962 - protein, 114 aa, Artificial Sequence; identical to SEQ ID NO: 224
  Description of Artificial Sequence: Synthetic polypeptide
  XENP024043 Human IL15

SEQ ID NO: 963 - protein, 231 aa, Artificial Sequence; identical to SEQ ID NO: 27
  Description of Artificial Sequence: Synthetic polypeptide
  Fc Chain of XENP024043

SEQ ID NO: 964 - protein, 301 aa, Artificial Sequence; identical to SEQ ID NO: 55
  Description of Artificial Sequence: Synthetic polypeptide
  XENP024043 Chain 2 - human_IL15Ralpha(Sushi)_(GGGGS)1_Fc(216)_ IgG1_C220S/PVA_/S267K/S364K/E357Q

SEQ ID NO: 965 - protein, 65 aa, Artificial Sequence; identical to SEQ ID NO: 4
  Description of Artificial Sequence: Synthetic polypeptide
  XENP024043 Human IL15Ralpha(Sushi)

SEQ ID NO: 966 - protein, 231 aa, Artificial Sequence; identical to SEQ ID NO: 26
  Description of Artificial Sequence: Synthetic polypeptide
  Fc Chain of XENP024043

SEQ ID NO: 967 - protein, 350 aa, Artificial Sequence
  Description of Artificial Sequence: Synthetic polypeptide
  XENP024044 Chain 1 - human_IL15_N1D/N4D/N65D_(GGGGS)1_Fc(216)_ IgG1_pI(-)_Isosteric_A_C220S/PVA_/S267K/L368D/K370S
DWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 968 - protein, 114 aa, Artificial Sequence; identical to SEQ ID NO: 225
  Description of Artificial Sequence: Synthetic polypeptide
  XENP024044 Human IL15

SEQ ID NO: 969 - protein, 231 aa, Artificial Sequence; identical to SEQ ID NO: 27
  Description of Artificial Sequence: Synthetic polypeptide
  Fc Chain of XENP024044

SEQ ID NO: 970 - protein, 301 aa, Artificial Sequence; identical to SEQ ID NO: 55
  Description of Artificial Sequence: Synthetic polypeptide
  XENP024044 Chain 2 - human_IL15Ralpha(Sushi)_(GGGGS)1_Fc(216)_ IgG1_pI(-)_Isosteric_A_C220S/PVA_/S267K/L368D/K370S-Fc(216)_ IgG1_C220S/PVA_/S267K/S364K/E357Q

SEQ ID NO: 971 - protein, 65 aa, Artificial Sequence; identical to SEQ ID NO: 4
  Description of Artificial Sequence: Synthetic polypeptide
  XENP024044 Human IL15Ralpha(Sushi)

SEQ ID NO: 972 - protein, 231 aa, Artificial Sequence; identical to SEQ ID NO: 26
  Description of Artificial Sequence: Synthetic polypeptide
  Fc Chain of XENP024044

SEQ ID NO: 973 - protein, 350 aa, Artificial Sequence; identical to SEQ ID NO: 270
  Description of Artificial Sequence: Synthetic polypeptide
  XENP024045 Chain 1 - human_IL15_D30N/E64Q/N65D_(GGGGS)1_ Fc(216)_IgG1_pI(-)_Isosteric_A_C220S/PVA_/S267K/L368D/ K370S

SEQ ID NO: 974 - protein, 114 aa, Artificial Sequence; identical to SEQ ID NO: 226
  Description of Artificial Sequence: Synthetic polypeptide
  XENP024045 Human IL15

SEQ ID NO: 975 - protein, 231 aa, Artificial Sequence; identical to SEQ ID NO: 27
  Description of Artificial Sequence: Synthetic polypeptide
  Fc Chain of XENP024045

SEQ ID NO: 976 - protein, 301 aa, Artificial Sequence; identical to SEQ ID NO: 55
  Description of Artificial Sequence: Synthetic polypeptide
  XENP024045 Chain 2 - human_IL15Ralpha(Sushi)_(GGGGS)1_ Fc(216)_ IgG1_C220S/PVA_/S267K/S364K/E357Q

SEQ ID NO: 977 - protein, 65 aa, Artificial Sequence; identical to SEQ ID NO: 4
  Description of Artificial Sequence: Synthetic polypeptide
  XENP024045 Human IL15Ralpha(Sushi)

SEQ ID NO: 978 - protein, 231 aa, Artificial Sequence; identical to SEQ ID NO: 26
  Description of Artificial Sequence: Synthetic polypeptide
  Fc Chain of XENP024045

SEQ ID NO: 979 - protein, 350 aa, Artificial Sequence
  Description of Artificial Sequence: Synthetic polypeptide
  XENP024048 Chain 1 - human_IL15_N4D/D61N/N65D_(GGGGS)1_Fc(216)_ IgG1_pI(-)_Isosteric_A_C220S/PVA_/S267K/L368D/K370S
NWVDVISDLKKIEDLIQSMHIDATLYTESDVHPSCKVTAMKCFLLELQVISLESGDASIHNTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 980 - protein, 114 aa, Artificial Sequence; identical to SEQ ID NO: 227
  Description of Artificial Sequence: Synthetic polypeptide
  XENP024048 Human IL15

SEQ ID NO: 981 - protein, 231 aa, Artificial Sequence; identical to SEQ ID NO: 27
  Description of Artificial Sequence: Synthetic polypeptide
  Fc Chain of XENP024048

SEQ ID NO: 982 - protein, 301 aa, Artificial Sequence; identical to SEQ ID NO: 55
  Description of Artificial Sequence: Synthetic polypeptide
  XENP024048 Chain 2 - human_IL15Ralpha(Sushi)_(GGGGS)1_ Fc(216)_ IgG1_C220S/PVA_/S267K/S364K/E357Q

SEQ ID NO: 983 - protein, 65 aa, Artificial Sequence; identical to SEQ ID NO: 4
  Description of Artificial Sequence: Synthetic polypeptide
  XENP024048 Human IL15Ralpha(Sushi)

SEQ ID NO: 984 - protein, 231 aa, Artificial Sequence; identical to SEQ ID NO: 26
  Description of Artificial Sequence: Synthetic polypeptide
  Fc Chain of XENP024048

SEQ ID NO: 985 - protein, 435 aa, Artificial Sequence; identical to SEQ ID NO: 293
  Description of Artificial Sequence: Synthetic polypeptide
  XENP024050 Chain 1 - human_IL15Ralpha(sushi)_(GGGGS)5-human_ IL15_N4D/N65D_(single-chain)_Fc(216)_IgG1_pI(-)_Isosteric_A_ C220S/PVA_/S267K/L368D/K370S

SEQ ID NO: 986 - protein, 65 aa, Artificial Sequence; identical to SEQ ID NO: 4
  Description of Artificial Sequence: Synthetic polypeptide
  XENP024050 Human IL15Ralpha(Sushi)

SEQ ID NO: 987 - protein, 114 aa, Artificial Sequence; identical to SEQ ID NO: 220
  Description of Artificial Sequence: Synthetic polypeptide
  XENP024050 Human IL15

SEQ ID NO: 988 - protein, 231 aa, Artificial Sequence; identical to SEQ ID NO: 27
  Description of Artificial Sequence: Synthetic polypeptide
  Fc Chain of XENP024050

SEQ ID NO: 989 - protein, 231 aa, Artificial Sequence; identical to SEQ ID NO: 26
  Description of Artificial Sequence: Synthetic polypeptide
  XENP024050 Chain 2 - empty_ Fc(216)_IgG1_C220S/PVA_ /S267K/S364K/E357Q

SEQ ID NO: 990 - protein, 345 aa, Artificial Sequence; identical to SEQ ID NO: 276
  Description of Artificial Sequence: Synthetic polypeptide
  XENP024051 Chain 1 - human_IL15_N1D/N65D-human_Fc(216)_IgG1_ pI(-)_Isosteric_A_C220S/PVA_/S267K/L368D/K370S

SEQ ID NO: 991 - protein, 114 aa, Artificial Sequence; identical to SEQ ID NO: 218
  Description of Artificial Sequence: Synthetic polypeptide
  XENP024051 Human IL15

SEQ ID NO: 992 - protein, 231 aa, Artificial Sequence; identical to SEQ ID NO: 27
  Description of Artificial Sequence: Synthetic polypeptide
  Fc Chain of XENP024051

SEQ ID NO: 993 - protein, 296 aa, Artificial Sequence; identical to SEQ ID NO: 61
  Description of Artificial Sequence: Synthetic polypeptide
  XENP024051 Chain 2 - human_IL15Ralpha(Sushi)_ Fc(216)_IgG1_ C220S/PVA_/S267K/S364K/E357Q

SEQ ID NO: 994 - protein, 65 aa, Artificial Sequence; identical to SEQ ID NO: 4
  Description of Artificial Sequence: Synthetic polypeptide
  XENP024051 Human IL15Ralpha(Sushi)

SEQ ID NO: 995 - protein, 231 aa, Artificial Sequence; identical to SEQ ID NO: 26
  Description of Artificial Sequence: Synthetic polypeptide
  Fc Chain of XENP024051

SEQ ID NO: 996 - protein, 345 aa, Artificial Sequence; identical to SEQ ID NO: 282
  Description of Artificial Sequence: Synthetic polypeptide
  XENP024052 Chain 1 - human_IL15_N4D/N65D-human_ Fc(216)_IgG1_ pI(-)_Isosteric_A_C220S/PVA_/S267K/L368D/K370S

SEQ ID NO: 997 - protein, 114 aa, Artificial Sequence; identical to SEQ ID NO: 220
  Description of Artificial Sequence: Synthetic polypeptide
  XENP024052 Human IL15

SEQ ID NO: 998 - protein, 231 aa, Artificial Sequence; identical to SEQ ID NO: 27
  Description of Artificial Sequence: Synthetic polypeptide
  Fc Chain of XENP024052

SEQ ID NO: 999 - protein, 296 aa, Artificial Sequence; identical to SEQ ID NO: 61
  Description of Artificial Sequence: Synthetic polypeptide
  XENP024052 Chain 2 - human_IL15Ralpha(Sushi)_Fc(216)_IgG1_ C220S/PVA_/S267K/S364K/E357Q

SEQ ID NO: 1000 - protein, 65 aa, Artificial Sequence; identical to SEQ ID NO: 4
  Description of Artificial Sequence: Synthetic polypeptide
  XENP024052 Human IL15Ralpha(Sushi)

SEQ ID NO: 1001 - protein, 231 aa, Artificial Sequence; identical to SEQ ID NO: 26
  Description of Artificial Sequence: Synthetic polypeptide
  Fc Chain of XENP024052

SEQ ID NO: 1002 - protein, 350 aa, Artificial Sequence; identical to SEQ ID NO: 370
  Description of Artificial Sequence: Synthetic polypeptide
  XENP024113 Chain 1 - human_IL15_N4D/N65D_(GGGGS)1_Fc(216)_IgG1_ pI(-)_Isosteric_A_C220S/PVA_/S267K/L368D/K370S/M428L/N434S

SEQ ID NO: 1003 - protein, 114 aa, Artificial Sequence; identical to SEQ ID NO: 220
  Description of Artificial Sequence: Synthetic polypeptide
  XENP024113 Human IL15

SEQ ID NO: 1004 - protein, 231 aa, Artificial Sequence; identical to SEQ ID NO: 47
  Description of Artificial Sequence: Synthetic polypeptide
  Fc Chain of XENP024113

SEQ ID NO: 1005 - protein, 301 aa, Artificial Sequence; identical to SEQ ID NO: 361
  Description of Artificial Sequence: Synthetic polypeptide
  XENP024113 Chain 2 -human_IL15Ralpha(Sushi)_(GGGGS)1_Fc(216)_ IgG1_C220S/PVA_/S267K/S364K/E357Q/M428L/N434S

SEQ ID NO: 1006 - protein, 65 aa, Artificial Sequence; identical to SEQ ID NO: 4
  Description of Artificial Sequence: Synthetic polypeptide
  XENP024113 Human IL15Ralpha(Sushi)

SEQ ID NO: 1007 - protein, 231 aa, Artificial Sequence; identical to SEQ ID NO: 46
  Description of Artificial Sequence: Synthetic polypeptide
  Fc Chain of XENP024113

SEQ ID NO: 1008 - protein, 345 aa, Artificial Sequence; identical to SEQ ID NO: 376
  Description of Artificial Sequence: Synthetic polypeptide
  XENP024301 Chain 1 - human_IL15_N4D/N65D_Fc(216)_IgG1_pI(-)_ Isosteric_A_C220S/PVA_/S267K/L368D/K370S/M428L/N434S

SEQ ID NO: 1009 - protein, 114 aa, Artificial Sequence; identical to SEQ ID NO: 220
  Description of Artificial Sequence: Synthetic polypeptide
  XENP024301 Human IL15

SEQ ID NO: 1010 - protein, 231 aa, Artificial Sequence; identical to SEQ ID NO: 47
  Description of Artificial Sequence: Synthetic polypeptide
  Fc Chain of XENP024301

SEQ ID NO: 1011 - protein, 296 aa, Artificial Sequence; identical to SEQ ID NO: 379
  Description of Artificial Sequence: Synthetic polypeptide
  XENP024301 Chain 2 - human_IL15Ralpha(Sushi)_ Fc(216)_IgG1_ C220S/PVA_/S267K/S364K/E357Q/M428L/N434S

SEQ ID NO: 1012 - protein, 65 aa, Artificial Sequence; identical to SEQ ID NO: 4
  Description of Artificial Sequence: Synthetic polypeptide
  XENP024301 Human IL15Ralpha(Sushi)

SEQ ID NO: 1013 - protein, 231 aa, Artificial Sequence; identical to SEQ ID NO: 46
  Description of Artificial Sequence: Synthetic polypeptide
  Fc Chain of XENP024301

SEQ ID NO: 1014 - protein, 350 aa, Artificial Sequence; identical to SEQ ID NO: 382
  Description of Artificial Sequence: Synthetic polypeptide
  XENP024306 Chain 1 - human_IL15_D30N/E64Q/N65D_(GGGGS)1_ Fc(216)_IgG1_pI(-)_Isosteric_A_C220S/PVA_/S267K/L368D/ K370S/M428L/N434S

SEQ ID NO: 1015 - protein, 114 aa, Artificial Sequence; identical to SEQ ID NO: 226
  Description of Artificial Sequence: Synthetic polypeptide
  XENP024306 Human IL15

SEQ ID NO: 1016 - protein, 231 aa, Artificial Sequence; identical to SEQ ID NO: 47
  Description of Artificial Sequence: Synthetic polypeptide
  Fc Chain of XENP024306

SEQ ID NO: 1017 - protein, 301 aa, Artificial Sequence; identical to SEQ ID NO: 361
  Description of Artificial Sequence: Synthetic polypeptide
  XENP024306 Chain 2 - human_IL15Ralpha(Sushi)_(GGGGS)1_Fc(216)_ IgG1_C220S/PVA_/S267K/S364K/E357Q/M428L/N434S

SEQ ID NO: 1018 - protein, 65 aa, Artificial Sequence; identical to SEQ ID NO: 4
  Description of Artificial Sequence: Synthetic polypeptide
  XENP024306 Human IL15Ralpha(Sushi)

SEQ ID NO: 1019 - protein, 231 aa, Artificial Sequence; identical to SEQ ID NO: 46
  Description of Artificial Sequence: Synthetic polypeptide
  Fc Chain of XENP024306

SEQ ID NO: 1020 - protein, 345 aa, Artificial Sequence; identical to SEQ ID NO: 388
  Description of Artificial Sequence: Synthetic polypeptide
  XENP024341 Chain 1 - human_IL15_N1D/N65D-human_Fc(216)_IgG1_ pI(-)_Isosteric_A_C220S/PVA_/S267K/L368D/K370S/M428L/N434S

SEQ ID NO: 1021 - protein, 114 aa, Artificial Sequence; identical to SEQ ID NO: 218
  Description of Artificial Sequence: Synthetic polypeptide
  XENP024341 Human IL15

SEQ ID NO: 1022 - protein, 231 aa, Artificial Sequence; identical to SEQ ID NO: 47
  Description of Artificial Sequence: Synthetic polypeptide
  Fc Chain of XENP024341

SEQ ID NO: 1023 - protein, 296 aa, Artificial Sequence; identical to SEQ ID NO: 379
  Description of Artificial Sequence: Synthetic polypeptide
  XENP024341 Chain 2 - human_IL15Ralpha(Sushi)_Fc(216)_IgG1_ C220S/PVA_/S267K/S364K/E357Q/M428L/N434S

SEQ ID NO: 1024 - protein, 65 aa, Artificial Sequence; identical to SEQ ID NO: 4
  Description of Artificial Sequence: Synthetic polypeptide
  XENP024341 Human IL15Ralpha(Sushi)

SEQ ID NO: 1025 - protein, 231 aa, Artificial Sequence; identical to SEQ ID NO: 46
  Description of Artificial Sequence: Synthetic polypeptide
  Fc Chain of XENP024341

SEQ ID NO: 1026 - protein, 296 aa, Artificial Sequence; identical to SEQ ID NO: 84
  Description of Artificial Sequence: Synthetic polypeptide
  XENP024342 Chain 1 - human_IL15Ralpha(Sushi) _Fc(216)_IgG1_ C220S/PVA_/S267K

SEQ ID NO: 1027 - protein, 65 aa, Artificial Sequence; identical to SEQ ID NO: 4
  Description of Artificial Sequence: Synthetic polypeptide
  XENP024342 Human IL15

SEQ ID NO: 1028 - protein, 231 aa, Artificial Sequence; identical to SEQ ID NO: 48
  Description of Artificial Sequence: Synthetic polypeptide
  Fc Chain of XENP024342

SEQ ID NO: 1029 - protein, 114 aa, Artificial Sequence; identical to SEQ ID NO: 205
  Description of Artificial Sequence: Synthetic polypeptide
  XENP024342 Chain 2 -human_IL15(non-covalent  Q108E)

SEQ ID NO: 1030 - protein, 296 aa, Artificial Sequence; identical to SEQ ID NO: 404
  Description of Artificial Sequence: Synthetic polypeptide
  XENP024346 Chain 1 - human_IL15Ralpha(Sushi)_Fc(216)_IgG1_ C220S/PVA_/S267K/M428L/N434S

SEQ ID NO: 1031 - protein, 65 aa, Artificial Sequence; identical to SEQ ID NO: 4
  Description of Artificial Sequence: Synthetic polypeptide
  XENP024346 Human IL15Ralpha(Sushi)

SEQ ID NO: 1032 - protein, 231 aa, Artificial Sequence; identical to SEQ ID NO: 406
  Description of Artificial Sequence: Synthetic polypeptide
  Fc Chain of XENP024346

SEQ ID NO: 1033 - protein, 114 aa, Artificial Sequence; identical to SEQ ID NO: 205
  Description of Artificial Sequence: Synthetic polypeptide
  XENP024346 Chain 2 - human_IL15(non-covalent  Q108E)

SEQ ID NO: 1034 - protein, 114 aa, Artificial Sequence; identical to SEQ ID NO: 2
  Description of Artificial Sequence: Synthetic polypeptide
  XENP024348 Chain 1 - IL15 WT

SEQ ID NO: 1035 - protein, 296 aa, Artificial Sequence; identical to SEQ ID NO: 80
  Description of Artificial Sequence: Synthetic polypeptide
  XENP024348 Chain 2 - human_IL15Ralpha(Sushi)_Fc(216)_IgG1_ pI(-)_Isosteric_A_C220S/PVA_/S267K/L368D/K370S

SEQ ID NO: 1036 - protein, 65 aa, Artificial Sequence; identical to SEQ ID NO: 4
  Description of Artificial Sequence: Synthetic polypeptide
  XENP024348 Human IL15Ralpha(Sushi)

SEQ ID NO: 1037 - protein, 231 aa, Artificial Sequence; identical to SEQ ID NO: 27
  Description of Artificial Sequence: Synthetic polypeptide
  Fc Chain of XENP024348

SEQ ID NO: 1038 - protein, 231 aa, Artificial Sequence; identical to SEQ ID NO: 26
  Description of Artificial Sequence: Synthetic polypeptide
  XENP024348 Chain 3 - empty_ Fc(216)_IgG1_C220S/PVA_ /S267K/S364K/E357Q

SEQ ID NO: 1039 - protein, 296 aa, Artificial Sequence; identical to SEQ ID NO: 80
  Description of Artificial Sequence: Synthetic polypeptide
  XENP024349 Chain 1 - human_IL15Ralpha(Sushi)_ Isosteric_A_ C220S/PVA_/S267K/L368D/K370S

SEQ ID NO: 1040 - protein, 65 aa, Artificial Sequence; identical to SEQ ID NO: 4
  Description of Artificial Sequence: Synthetic polypeptide
  XENP024349 Human IL15Ralpha(Sushi)

SEQ ID NO: 1041 - protein, 231 aa, Artificial Sequence; identical to SEQ ID NO: 27
  Description of Artificial Sequence: Synthetic polypeptide
  Fc Chain of XENP024349

SEQ ID NO: 1042 - protein, 231 aa, Artificial Sequence; identical to SEQ ID NO: 26
  Description of Artificial Sequence: Synthetic polypeptide
  XENP024349 Chain 2 - empty- Fc(216)_IgG1_C220S/PVA_ /S267K/S364K/E357Q

SEQ ID NO: 1043 - protein, 114 aa, Artificial Sequence; identical to SEQ ID NO: 205
  Description of Artificial Sequence: Synthetic polypeptide
  XENP024349 Chain 3 - IL15_Q108E_(non-covalent)

SEQ ID NO: 1044 - protein, 114 aa, Artificial Sequence; identical to SEQ ID NO: 220
  Description of Artificial Sequence: Synthetic polypeptide
  XENP024351 Chain 1 - IL15(N4D/N65D)

SEQ ID NO: 1045 - protein, 296 aa, Artificial Sequence; identical to SEQ ID NO: 404
  Description of Artificial Sequence: Synthetic polypeptide
  XENP024351 Chain 2 - human_IL15Ralpha(Sushi)_Fc(216)_IgG1_ C220S/PVA_/S267K/M428L/N434S

SEQ ID NO: 1046 - protein, 65 aa, Artificial Sequence; identical to SEQ ID NO: 4
  Description of Artificial Sequence: Synthetic polypeptide
  XENP024351 Human IL15Ralpha(Sushi)

SEQ ID NO: 1047 - protein, 231 aa, Artificial Sequence; identical to SEQ ID NO: 406
  Description of Artificial Sequence: Synthetic polypeptide
  Fc Chain of XENP024351

SEQ ID NO: 1048 - protein, 114 aa, Artificial Sequence; identical to SEQ ID NO: 205
  Description of Artificial Sequence: Synthetic polypeptide
  XENP024383 Chain 1 - IL15_Q108E

SEQ ID NO: 1049 - protein, 296 aa, Artificial Sequence; identical to SEQ ID NO: 400
  Description of Artificial Sequence: Synthetic polypeptide
  XENP024383 Chain 2 - human_IL15Ralpha(Sushi)_Fc(216)_IgG1_ pI(-)_Isosteric_A_C220S/PVA_/S267K/L368D/K370S/M428L/N434S

SEQ ID NO: 1050 - protein, 65 aa, Artificial Sequence; identical to SEQ ID NO: 4
  Description of Artificial Sequence: Synthetic polypeptide
  XENP024383 Human IL15Ralpha(Sushi)

SEQ ID NO: 1051 - protein, 231 aa, Artificial Sequence; identical to SEQ ID NO: 47
  Description of Artificial Sequence: Synthetic polypeptide
  Fc Chain of XENP024383

SEQ ID NO: 1052 - protein, 231 aa, Artificial Sequence; identical to SEQ ID NO: 46
  Description of Artificial Sequence: Synthetic polypeptide
  XENP024383 Chain 3 - empty_ Fc(216)_IgG1_C220S/PVA_ /S267K/S364K/E357Q/M428L/N434S

SEQ ID NO: 1053 - protein, 440 aa, Artificial Sequence; identical to SEQ ID NO: 298
  Description of Artificial Sequence: Synthetic polypeptide
  XENP024475 Chain 1 - human_IL15Ralpha(sushi)_(GGGGS)6-human_ IL15(single-chain Q108E)_Fc(216)_IgG1_pI(-)_Isosteric_A_ C220S/PVA_/S267K/L368D/K370S

SEQ ID NO: 1054 - protein, 65 aa, Artificial Sequence; identical to SEQ ID NO: 4
  Description of Artificial Sequence: Synthetic polypeptide
  XENP024475 Human IL15Ralpha(Sushi)

SEQ ID NO: 1055 - protein, 114 aa, Artificial Sequence; identical to SEQ ID NO: 205
  Description of Artificial Sequence: Synthetic polypeptide
  XENP024475 Human IL15

SEQ ID NO: 1056 - protein, 231 aa, Artificial Sequence; identical to SEQ ID NO: 27
  Description of Artificial Sequence: Synthetic polypeptide
  Fc Chain of XENP024475

SEQ ID NO: 1057 - protein, 231 aa, Artificial Sequence; identical to SEQ ID NO: 26
  Description of Artificial Sequence: Synthetic polypeptide
  XENP024475 Chain 2 - empty_ Fc(216)_IgG1_C220S/PVA_ /S267K/S364K/E357Q

SEQ ID NO: 1058 - protein, 440 aa, Artificial Sequence; identical to SEQ ID NO: 303
  Description of Artificial Sequence: Synthetic polypeptide
  XENP024476 Chain 1 - human_IL15Ralpha(sushi)_(GGGGS)6-human_ IL15(single-chain N4D/N65D)_Fc(216)_IgG1_pI(-)_Isosteric_A_ C220S/PVA_/S267K/L368D/K370S

SEQ ID NO: 1059 - protein, 65 aa, Artificial Sequence; identical to SEQ ID NO: 4
  Description of Artificial Sequence: Synthetic polypeptide
  XENP024476 Human IL15Ralpha(Sushi)

SEQ ID NO: 1060 - protein, 114 aa, Artificial Sequence; identical to SEQ ID NO: 220
  Description of Artificial Sequence: Synthetic polypeptide
  XENP024476 Human IL15

SEQ ID NO: 1061 - protein, 231 aa, Artificial Sequence; identical to SEQ ID NO: 27
  Description of Artificial Sequence: Synthetic polypeptide
  Fc Chain of XENP024476

SEQ ID NO: 1062 - protein, 231 aa, Artificial Sequence; identical to SEQ ID NO: 26
  Description of Artificial Sequence: Synthetic polypeptide
  XENP024476 Chain 2 - empty_ Fc(216)_IgG1_C220S/PVA_ /S267K/S364K/E357Q

SEQ ID NO: 1063 - protein, 445 aa, Artificial Sequence
  Description of Artificial Sequence: Synthetic polypeptide
  XENP024477 Chain 1 - human_IL15Ralpha(sushi)_(GGGGS)7-human_ IL15(single-chain)_Fc(216)_IgG1_pI(-)_Isosteric_A_ C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1064 - protein, 65 aa, Artificial Sequence; identical to SEQ ID NO: 4
  Description of Artificial Sequence: Synthetic polypeptide
  XENP024477 Human IL15Ralpha(Sushi)

SEQ ID NO: 1065 - protein, 114 aa, Artificial Sequence; identical to SEQ ID NO: 2
  Description of Artificial Sequence: Synthetic polypeptide
  XENP024477 Human IL15

SEQ ID NO: 1066 - protein, 231 aa, Artificial Sequence; identical to SEQ ID NO: 27
  Description of Artificial Sequence: Synthetic polypeptide
  Fc Chain of XENP024477

SEQ ID NO: 1067 - protein, 231 aa, Artificial Sequence; identical to SEQ ID NO: 26
  Description of Artificial Sequence: Synthetic polypeptide
  XENP024477 Chain 2 - empty_Fc(216)_IgG1_C220S/PVA_ /S267K/S364K/E357Q

SEQ ID NO: 1068 - protein, 445 aa, Artificial Sequence; identical to SEQ ID NO: 308
  Description of Artificial Sequence: Synthetic polypeptide
  XENP024478 Chain 1 - human_IL15Ralpha(sushi)_(GGGGS)7-human_ IL15(single-chain Q108E)_Fc(216)_IgG1_pI(-)_Isosteric_A_ C220S/PVA_/S267K/L368D/K370S

SEQ ID NO: 1069 - protein, 65 aa, Artificial Sequence; identical to SEQ ID NO: 4
  Description of Artificial Sequence: Synthetic polypeptide
  XENP024478 Human IL15Ralpha(Sushi)

SEQ ID NO: 1070 - protein, 114 aa, Artificial Sequence; identical to SEQ ID NO: 205
  Description of Artificial Sequence: Synthetic polypeptide
  XENP024478 Human IL15

SEQ ID NO: 1071 - protein, 231 aa, Artificial Sequence; identical to SEQ ID NO: 27
  Description of Artificial Sequence: Synthetic polypeptide
  Fc Chain of XENP024478

SEQ ID NO: 1072 - protein, 231 aa, Artificial Sequence; identical to SEQ ID NO: 26
  Description of Artificial Sequence: Synthetic polypeptide
  XENP024478 Chain 2 - empty_ Fc(216)_IgG1_C220S/PVA_ /S267K/S364K/E357Q

SEQ ID NO: 1073 - protein, 445 aa, Artificial Sequence; identical to SEQ ID NO: 313
  Description of Artificial Sequence: Synthetic polypeptide
  XENP024479 Chain 1 - human_IL15Ralpha(sushi)_(GGGGS)7-human_ IL15(single-chain N4D/N65D)_Fc(216)_IgG1_pI(-)_Isosteric_A_ C220S/PVA_/S267K/L368D/K370S

SEQ ID NO: 1074 - protein, 65 aa, Artificial Sequence; identical to SEQ ID NO: 4
  Description of Artificial Sequence: Synthetic polypeptide
  XENP024479 Human IL15Ralpha(Sushi)

SEQ ID NO: 1075 - protein, 114 aa, Artificial Sequence; identical to SEQ ID NO: 220
  Description of Artificial Sequence: Synthetic polypeptide
  XENP024479 Human IL15

SEQ ID NO: 1076 - protein, 231 aa, Artificial Sequence; identical to SEQ ID NO: 27
  Description of Artificial Sequence: Synthetic polypeptide
  Fc Chain of XENP024479

SEQ ID NO: 1077 - protein, 231 aa, Artificial Sequence; identical to SEQ ID NO: 26
  Description of Artificial Sequence: Synthetic polypeptide
  XENP024479 Chain 2 - empty-Fc_Fc(216)_IgG1_C220S/PVA_ /S267K/S364K/E357Q

SEQ ID NO: 1078 - protein, 440 aa, Artificial Sequence
  Description of Artificial Sequence: Synthetic polypeptide
  XENP024480 Chain 1 - human_IL15Ralpha(sushi)_(30AA_linker_ variant)-human_IL15(single-chain)_Fc(216)_IgG1_pI(-)_ Isosteric_A_C220S/PVA_/S267K/L368D/K370S
ITCPPPMSVEHADIWVKSYSLYSRERYICNSGFKRKAGTSSLTECVLNKATNVAHWTTPSLKCIRDPALVHQRPAPPGGGGSGGGGSGGGGSGGGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1079 - protein, 65 aa, Artificial Sequence; identical to SEQ ID NO: 4
  Description of Artificial Sequence: Synthetic polypeptide
  XENP024480 Human IL15Ralpha(Sushi)

SEQ ID NO: 1080 - protein, 114 aa, Artificial Sequence; identical to SEQ ID NO: 2
  Description of Artificial Sequence: Synthetic polypeptide
  XENP024480 Human IL15

SEQ ID NO: 1081 - protein, 231 aa, Artificial Sequence; identical to SEQ ID NO: 27
  Description of Artificial Sequence: Synthetic polypeptide
  Fc Chain of XENP024480

SEQ ID NO: 1082 - protein, 231 aa, Artificial Sequence; identical to SEQ ID NO: 26
  Description of Artificial Sequence: Synthetic polypeptide
  XENP024480 Chain 2 - empty_ Fc(216)_IgG1_C220S/PVA_ /S267K/S364K/E357Q

SEQ ID NO: 1083 - protein, 440 aa, Artificial Sequence; identical to SEQ ID NO: 318
  Description of Artificial Sequence: Synthetic polypeptide
  XENP024481 Chain 1 - human_IL15Ralpha(sushi)_(30AA_linker_ variant)-human_IL15(single-chain Q108E)_Fc(216)_IgG1_pI(- )_Isosteric_A_C220S/PVA_/S267K/L368D/K370S

SEQ ID NO: 1084 - protein, 65 aa, Artificial Sequence; identical to SEQ ID NO: 4
  Description of Artificial Sequence: Synthetic polypeptide
  XENP024481 Human IL15Ralpha(Sushi)

SEQ ID NO: 1085 - protein, 114 aa, Artificial Sequence; identical to SEQ ID NO: 205
  Description of Artificial Sequence: Synthetic polypeptide
  XENP024481 Human IL15

SEQ ID NO: 1086 - protein, 231 aa, Artificial Sequence; identical to SEQ ID NO: 27
  Description of Artificial Sequence: Synthetic polypeptide
  Fc Chain of XENP024481

SEQ ID NO: 1087 - protein, 231 aa, Artificial Sequence; identical to SEQ ID NO: 26
  Description of Artificial Sequence: Synthetic polypeptide
  XENP024481 Chain 2 - empty_ Fc(216)_IgG1_C220S/PVA_ /S267K/S364K/E357Q

SEQ ID NO: 1088 - protein, 296 aa, Artificial Sequence; identical to SEQ ID NO: 80
  Description of Artificial Sequence: Synthetic polypeptide
  XENP024890 Chain 1 - IL-15_N4D/N65D

SEQ ID NO: 1089 - protein, 65 aa, Artificial Sequence; identical to SEQ ID NO: 4
  Description of Artificial Sequence: Synthetic polypeptide
  XENP024890 IL15

SEQ ID NO: 1090 - protein, 231 aa, Artificial Sequence; identical to SEQ ID NO: 27
  Description of Artificial Sequence: Synthetic polypeptide
  Fc Chain of XENP024890

SEQ ID NO: 1091 - protein, 296 aa, Artificial Sequence; identical to SEQ ID NO: 80
  Description of Artificial Sequence: Synthetic polypeptide
  XENP024890 Chain 2 - human_IL15Ralpha(Sushi)_Fc(216)_IgG1_ pI(-)_Isosteric_A_C220S/PVA_/S267K/L368D/K370S

SEQ ID NO: 1092 - protein, 65 aa, Artificial Sequence; identical to SEQ ID NO: 4
  Description of Artificial Sequence: Synthetic polypeptide
  XENP024890 Human IL15Ralpha(Sushi)

SEQ ID NO: 1093 - protein, 231 aa, Artificial Sequence; identical to SEQ ID NO: 27
  Description of Artificial Sequence: Synthetic polypeptide
  Fc Chain of XENP024890

SEQ ID NO: 1094 - protein, 231 aa, Artificial Sequence; identical to SEQ ID NO: 26
  Description of Artificial Sequence: Synthetic polypeptide
  XENP024890 Chain 3 - empty_Fc(216)_ IgG1_PVA_ /S267K/S364K/E357Q

SEQ ID NO: 1095 - protein, 114 aa, Artificial Sequence; identical to SEQ ID NO: 226
  Description of Artificial Sequence: Synthetic polypeptide
  XENP25138 Chain 1 - IL15_D30N/E64Q/N65D

SEQ ID NO: 1096 - protein, 296 aa, Artificial Sequence; identical to SEQ ID NO: 80
  Description of Artificial Sequence: Synthetic polypeptide
  XENP25138 Chain 2 - human_IL15Ralpha(Sushi)_Fc(216)_IgG1_pI(-)_ Isosteric_A_C220S/PVA_/S267K/L368D/K370S

SEQ ID NO: 1097 - protein, 65 aa, Artificial Sequence; identical to SEQ ID NO: 4
  Description of Artificial Sequence: Synthetic polypeptide
  XENP25138 Human IL15Ralpha(Sushi)

SEQ ID NO: 1098 - protein, 231 aa, Artificial Sequence; identical to SEQ ID NO: 27
  Description of Artificial Sequence: Synthetic polypeptide
  Fc Chain of XENP25138

SEQ ID NO: 1099 - protein, 231 aa, Artificial Sequence; identical to SEQ ID NO: 26
  Description of Artificial Sequence: Synthetic polypeptide
  XENP25138 Chain 3 - empty_Fc(216)_ IgG1_PVA_/S267K/S364K/E357Q

SEQ ID NO: 1100 - protein, 435 aa, Artificial Sequence; identical to SEQ ID NO: 394
  Description of Artificial Sequence: Synthetic polypeptide
  XENP025938 Chain 1 - human_IL15Ralpha(sushi)_(GGGGS)5-human_ IL15_N4D/N65D_(single-chain)-_Fc(216)_IgG1_pI(-)_Isosteric_ A_C220S/PVA_/S267K/L368D/K370S/M428L/N434S

SEQ ID NO: 1101 - protein, 65 aa, Artificial Sequence; identical to SEQ ID NO: 4
  Description of Artificial Sequence: Synthetic polypeptide
  XENP025938 Human IL15Ralpha(Sushi)

SEQ ID NO: 1102 - protein, 114 aa, Artificial Sequence; identical to SEQ ID NO: 220
  Description of Artificial Sequence: Synthetic polypeptide
  XENP025938 Human IL15

SEQ ID NO: 1103 - protein, 231 aa, Artificial Sequence; identical to SEQ ID NO: 47
  Description of Artificial Sequence: Synthetic polypeptide
  Fc Chain of XENP025938

SEQ ID NO: 1104 - protein, 231 aa, Artificial Sequence; identical to SEQ ID NO: 46
  Description of Artificial Sequence: Synthetic polypeptide
  XENP025938 Chain 2 - empty_Fc(216)_IgG1_C220S/PVA_ /S267K/S364K/E357Q/M428L/N434S

SEQ ID NO: 1105 - protein, 415 aa, Artificial Sequence; identical to SEQ ID NO: 88
  Description of Artificial Sequence: Synthetic polypeptide
  XENP025938 human_IL15Ralpha(sushi)(single-chain)-human_IL15_ Fc(216)_IgG1_C220S/PVA_/S267K

SEQ ID NO: 1106 - protein, 65 aa, Artificial Sequence; identical to SEQ ID NO: 4
  Description of Artificial Sequence: Synthetic polypeptide
  XENP025938 Human IL15Ralpha(Sushi)

SEQ ID NO: 1107 - protein, 114 aa, Artificial Sequence; identical to SEQ ID NO: 2
  Description of Artificial Sequence: Synthetic polypeptide
  XENP025938 Human IL15

SEQ ID NO: 1108 - protein, 231 aa, Artificial Sequence; identical to SEQ ID NO: 48
  Description of Artificial Sequence: Synthetic polypeptide
  Fc Chain of XENP025938

SEQ ID NO: 1109 - protein, 425 aa, Artificial Sequence; identical to SEQ ID NO: 97
  Description of Artificial Sequence: Synthetic polypeptide
  Chain 1 - empty-Fc(216)_IgG1_pI(-)_Isosteric_A_C220S/PVA_ /S267K/L368D/K370S_(GGGGS)2_IL15Ralpha(Sushi)_IL15(single -chain)

SEQ ID NO: 1110 - protein, 231 aa, Artificial Sequence; identical to SEQ ID NO: 27
  Description of Artificial Sequence: Synthetic polypeptide
  Fc Chain of Chain 1 - empty-Fc(216)_IgG1_pI(-)_Isosteric_A_ C220S/PVA_/S267K/L368D/K370S_(GGGGS)2_IL15Ralpha(Sushi)_ IL15(single-chain)

SEQ ID NO: 1111 - protein, 65 aa, Artificial Sequence; identical to SEQ ID NO: 4
  Description of Artificial Sequence: Synthetic polypeptide
  Chain 1 - empty-Fc(216)_IgG1_pI(-)_Isosteric_A_C220S/PVA_ /S267K/L368D/K370S_(GGGGS)2_IL15Ralpha(Sushi)_IL15(single -chain) IL15Ralpha(Sushi)

SEQ ID NO: 1112 - protein, 114 aa, Artificial Sequence; identical to SEQ ID NO: 2
  Description of Artificial Sequence: Synthetic polypeptide
  Chain 1 - empty-Fc(216)_IgG1_pI(-)_Isosteric_A_C220S/PVA_ /S267K/L368D/K370S_(GGGGS)2_IL15Ralpha(Sushi)_IL15(single -chain) IL15

SEQ ID NO: 1113 - protein, 231 aa, Artificial Sequence; identical to SEQ ID NO: 51
  Description of Artificial Sequence: Synthetic polypeptide
  Chain 2 - empty-Fc(216)_IgG1_ISO(+RR)_C220S/PVA_ /S267K/S364K/E357Q (8927)

SEQ ID NO: 1114 - protein, 162 aa, Homo sapiens; identical to SEQ ID NO: 1

SEQ ID NO: 1115 - protein, 114 aa, Homo sapiens; identical to SEQ ID NO: 2

SEQ ID NO: 1116 - protein, 267 aa, Homo sapiens; identical to SEQ ID NO: 3

SEQ ID NO: 1117 - protein, 175 aa, Homo sapiens; identical to SEQ ID NO: 8

SEQ ID NO: 1118 - protein, 65 aa, Homo sapiens; identical to SEQ ID NO: 4

SEQ ID NO: 1119 - protein, 551 aa, Homo sapiens; identical to SEQ ID NO: 10

SEQ ID NO: 1120 - protein, 214 aa, Homo sapiens; identical to SEQ ID NO: 11

SEQ ID NO: 1121 - protein, 369 aa, Homo sapiens; identical to SEQ ID NO: 12

SEQ ID NO: 1122 - protein, 240 aa, Homo sapiens; identical to SEQ ID NO: 13

SEQ ID NO: 1123 - protein, 231 aa, Artificial Sequence; identical to SEQ ID NO: 26
  Description of Artificial Sequence: Synthetic polypeptide
  IL-15/Ralpha-Fc monomer 1

SEQ ID NO: 1124 - protein, 231 aa, Artificial Sequence; identical to SEQ ID NO: 27
  Description of Artificial Sequence: Synthetic polypeptide
  IL-15/Ralpha-Fc monomer 2

SEQ ID NO: 1125 - protein, 231 aa, Artificial Sequence; identical to SEQ ID NO: 28
  Description of Artificial Sequence: Synthetic polypeptide
  IL-15/Ralpha-Fc monomer 1

SEQ ID NO: 1126 - protein, 231 aa, Artificial Sequence; identical to SEQ ID NO: 27
  Description of Artificial Sequence: Synthetic polypeptide
  IL-15/Ralpha-Fc monomer 2

SEQ ID NO: 1127 - protein, 231 aa, Artificial Sequence; identical to SEQ ID NO: 28
  Description of Artificial Sequence: Synthetic polypeptide
  IL-15/Ralpha-Fc monomer 1

SEQ ID NO: 1128 - protein, 231 aa, Artificial Sequence; identical to SEQ ID NO: 31
  Description of Artificial Sequence: Synthetic polypeptide
  IL-15/Ralpha-Fc monomer 2

SEQ ID NO: 1129 - protein, 231 aa, Artificial Sequence; identical to SEQ ID NO: 32
  Description of Artificial Sequence: Synthetic polypeptide
  IL-15/Ralpha-Fc monomer 1

SEQ ID NO: 1130 - protein, 231 aa, Artificial Sequence; identical to SEQ ID NO: 33
  Description of Artificial Sequence: Synthetic polypeptide
  IL-15/Ralpha-Fc monomer 2

SEQ ID NO: 1131 - protein, 231 aa, Artificial Sequence; identical to SEQ ID NO: 34
  Description of Artificial Sequence: Synthetic polypeptide
  IL-15/Ralpha-Fc monomer 1

SEQ ID NO: 1132 - protein, 231 aa, Artificial Sequence; identical to SEQ ID NO: 35
  Description of Artificial Sequence: Synthetic polypeptide
  IL-15/Ralpha-Fc monomer 2

SEQ ID NO: 1133 - protein, 231 aa, Artificial Sequence; identical to SEQ ID NO: 36
  Description of Artificial Sequence: Synthetic polypeptide
  IL-15/Ralpha-Fc monomer 1

SEQ ID NO: 1134 - protein, 231 aa, Artificial Sequence; identical to SEQ ID NO: 37
  Description of Artificial Sequence: Synthetic polypeptide
  IL-15/Ralpha-Fc monomer 2

SEQ ID NO: 1135 - protein, 231 aa, Artificial Sequence; identical to SEQ ID NO: 38
  Description of Artificial Sequence: Synthetic polypeptide
  IL-15/Ralpha-Fc monomer 1

SEQ ID NO: 1136 - protein, 231 aa, Artificial Sequence; identical to SEQ ID NO: 39
  Description of Artificial Sequence: Synthetic polypeptide
  IL-15/Ralpha-Fc monomer 2

SEQ ID NO: 1137 - protein, 229 aa, Artificial Sequence; identical to SEQ ID NO: 40
  Description of Artificial Sequence: Synthetic polypeptide
  IL-15/Ralpha-Fc monomer 1

SEQ ID NO: 1138 - protein, 229 aa, Artificial Sequence; identical to SEQ ID NO: 41
  Description of Artificial Sequence: Synthetic polypeptide
  IL-15/Ralpha-Fc monomer 2

SEQ ID NO: 1139 - protein, 228 aa, Artificial Sequence; identical to SEQ ID NO: 42
  Description of Artificial Sequence: Synthetic polypeptide
  IL-15/Ralpha-Fc monomer 1

SEQ ID NO: 1140 - protein, 228 aa, Artificial Sequence; identical to SEQ ID NO: 43
  Description of Artificial Sequence: Synthetic polypeptide
  IL-15/Ralpha-Fc monomer 2

SEQ ID NO: 1141 - protein, 228 aa, Artificial Sequence; identical to SEQ ID NO: 44
  Description of Artificial Sequence: Synthetic polypeptide
  IL-15/Ralpha-Fc monomer 1

SEQ ID NO: 1142 - protein, 228 aa, Artificial Sequence; identical to SEQ ID NO: 45
  Description of Artificial Sequence: Synthetic polypeptide
  IL-15/Ralpha-Fc monomer 2

SEQ ID NO: 1143 - protein, 231 aa, Artificial Sequence; identical to SEQ ID NO: 46
  Description of Artificial Sequence: Synthetic polypeptide
  IL-15/Ralpha-Fc monomer 1

SEQ ID NO: 1144 - protein, 231 aa, Artificial Sequence; identical to SEQ ID NO: 47
  Description of Artificial Sequence: Synthetic polypeptide
  IL-15/Ralpha-Fc monomer 2

SEQ ID NO: 1145 - protein, 231 aa, Artificial Sequence; identical to SEQ ID NO: 48
  Description of Artificial Sequence: Synthetic polypeptide
  IL-15/Ralpha-Fc monomer 1

SEQ ID NO: 1146 - protein, 231 aa, Artificial Sequence; identical to SEQ ID NO: 48
  Description of Artificial Sequence: Synthetic polypeptide
  IL-15/Ralpha-Fc monomer 2

SEQ ID NO: 1147 - protein, 231 aa, Artificial Sequence; identical to SEQ ID NO: 27
  Description of Artificial Sequence: Synthetic polypeptide
  IL-15/Ralpha-Fc monomer 1

SEQ ID NO: 1148 - protein, 231 aa, Artificial Sequence; identical to SEQ ID NO: 51
  Description of Artificial Sequence: Synthetic polypeptide
  IL-15/Ralpha-Fc monomer 2

SEQ ID NO: 1149 - protein, 66 aa, Artificial Sequence; identical to SEQ ID NO: 102
  Description of Artificial Sequence: Synthetic polypeptide
  IL-15Ralpha(sushi-D96)

SEQ ID NO: 1150 - protein, 67 aa, Artificial Sequence; identical to SEQ ID NO: 103
  Description of Artificial Sequence: Synthetic polypeptide
  IL-15Ralpha(sushi-D96/P97)

SEQ ID NO: 1151 - protein, 68 aa, Artificial Sequence; identical to SEQ ID NO: 104
  Description of Artificial Sequence: Synthetic polypeptide
  IL-15Ralpha(sushi-D96/P97/A98)

SEQ ID NO: 1152 - protein, 114 aa, Artificial Sequence; identical to SEQ ID NO: 105
  Description of Artificial Sequence: Synthetic polypeptide
  IL-15(E87C)

SEQ ID NO: 1153 - protein, 114 aa, Artificial Sequence; identical to SEQ ID NO: 106
  Description of Artificial Sequence: Synthetic polypeptide
  IL-15(V49C)

SEQ ID NO: 1154 - protein, 114 aa, Artificial Sequence; identical to SEQ ID NO: 107
  Description of Artificial Sequence: Synthetic polypeptide
  IL-15(L52C)

SEQ ID NO: 1155 - protein, 114 aa, Artificial Sequence; identical to SEQ ID NO: 108
  Description of Artificial Sequence: Synthetic polypeptide
  IL-15(E89C)

SEQ ID NO: 1156 - protein, 114 aa, Artificial Sequence; identical to SEQ ID NO: 109
  Description of Artificial Sequence: Synthetic polypeptide
  IL-15(Q48C)

SEQ ID NO: 1157 - protein, 114 aa, Artificial Sequence; identical to SEQ ID NO: 110
  Description of Artificial Sequence: Synthetic polypeptide
  IL-15(E53C)

SEQ ID NO: 1158 - protein, 114 aa, Artificial Sequence; identical to SEQ ID NO: 111
  Description of Artificial Sequence: Synthetic polypeptide
  IL-15(C42S)

SEQ ID NO: 1159 - protein, 114 aa, Artificial Sequence; identical to SEQ ID NO: 112
  Description of Artificial Sequence: Synthetic polypeptide
  IL-15(L45C)

SEQ ID NO: 1160 - protein, 67 aa, Artificial Sequence; identical to SEQ ID NO: 113
  Description of Artificial Sequence: Synthetic polypeptide
  IL-15Ralpha(sushi-D96/C97)

SEQ ID NO: 1161 - protein, 68 aa, Artificial Sequence; identical to SEQ ID NO: 114
  Description of Artificial Sequence: Synthetic polypeptide
  IL-15Ralpha(sushi-D96/P97/C98)

SEQ ID NO: 1162 - protein, 68 aa, Artificial Sequence; identical to SEQ ID NO: 115
  Description of Artificial Sequence: Synthetic polypeptide
  IL-15Ralpha(sushi-D96/C97/A98)

SEQ ID NO: 1163 - protein, 65 aa, Artificial Sequence; identical to SEQ ID NO: 116
  Description of Artificial Sequence: Synthetic polypeptide
  IL-15Ralpha(sushi-S40C) of

SEQ ID NO: 1164 - protein, 65 aa, Artificial Sequence; identical to SEQ ID NO: 117
  Description of Artificial Sequence: Synthetic polypeptide
  IL-15Ralpha(sushi-K34C)

SEQ ID NO: 1165 - protein, 65 aa, Artificial Sequence; identical to SEQ ID NO: 118
  Description of Artificial Sequence: Synthetic polypeptide
  IL-15Ralpha(sushi-G38C)

SEQ ID NO: 1166 - protein, 65 aa, Artificial Sequence; identical to SEQ ID NO: 119
  Description of Artificial Sequence: Synthetic polypeptide
  IL-15Ralpha(sushi-L42C)

SEQ ID NO: 1167 - protein, 65 aa, Artificial Sequence; identical to SEQ ID NO: 120
  Description of Artificial Sequence: Synthetic polypeptide
  IL-15Ralpha(sushi-A37C)

SEQ ID NO: 1168 - protein, 114 aa, Artificial Sequence; identical to SEQ ID NO: 198
  Description of Artificial Sequence: Synthetic polypeptide
  N1D

SEQ ID NO: 1169 - protein, 114 aa, Artificial Sequence; identical to SEQ ID NO: 199
  Description of Artificial Sequence: Synthetic polypeptide
  N4D

SEQ ID NO: 1170 - protein, 114 aa, Artificial Sequence; identical to SEQ ID NO: 200
  Description of Artificial Sequence: Synthetic polypeptide
  D8N

SEQ ID NO: 1171 - protein, 114 aa, Artificial Sequence; identical to SEQ ID NO: 201
  Description of Artificial Sequence: Synthetic polypeptide
  D30N

SEQ ID NO: 1172 - protein, 114 aa, Artificial Sequence; identical to SEQ ID NO: 202
  Description of Artificial Sequence: Synthetic polypeptide
  D61N

SEQ ID NO: 1173 - protein, 114 aa, Artificial Sequence; identical to SEQ ID NO: 203
  Description of Artificial Sequence: Synthetic polypeptide
  E64Q

SEQ ID NO: 1174 - protein, 114 aa, Artificial Sequence; identical to SEQ ID NO: 204
  Description of Artificial Sequence: Synthetic polypeptide
  N65D

SEQ ID NO: 1175 - protein, 114 aa, Artificial Sequence; identical to SEQ ID NO: 205
  Description of Artificial Sequence: Synthetic polypeptide
  Q108E

SEQ ID NO: 1176 - protein, 114 aa, Artificial Sequence; identical to SEQ ID NO: 206
  Description of Artificial Sequence: Synthetic polypeptide
  N1D/D61N

SEQ ID NO: 1177 - protein, 114 aa, Artificial Sequence; identical to SEQ ID NO: 207
  Description of Artificial Sequence: Synthetic polypeptide
  N1D/E64Q

SEQ ID NO: 1178 - protein, 114 aa, Artificial Sequence; identical to SEQ ID NO: 208
  Description of Artificial Sequence: Synthetic polypeptide
  N4D/D61N

SEQ ID NO: 1179 - protein, 114 aa, Artificial Sequence; identical to SEQ ID NO: 209
  Description of Artificial Sequence: Synthetic polypeptide
  N4D/E64Q

SEQ ID NO: 1180 - protein, 114 aa, Artificial Sequence; identical to SEQ ID NO: 210
  Description of Artificial Sequence: Synthetic polypeptide
  D8N/D61N

SEQ ID NO: 1181 - protein, 114 aa, Artificial Sequence; identical to SEQ ID NO: 211
  Description of Artificial Sequence: Synthetic polypeptide
  D8N/E64Q

SEQ ID NO: 1182 - protein, 114 aa, Artificial Sequence; identical to SEQ ID NO: 212
  Description of Artificial Sequence: Synthetic polypeptide
  D61N/E64Q

SEQ ID NO: 1183 - protein, 114 aa, Artificial Sequence; identical to SEQ ID NO: 213
  Description of Artificial Sequence: Synthetic polypeptide
  E64Q/Q108E

SEQ ID NO: 1184 - protein, 114 aa, Artificial Sequence; identical to SEQ ID NO: 214
  Description of Artificial Sequence: Synthetic polypeptide
  N1D/N4D/D8N

SEQ ID NO: 1185 - protein, 114 aa, Artificial Sequence; identical to SEQ ID NO: 215
  Description of Artificial Sequence: Synthetic polypeptide
  D61N/E64Q/N65D

SEQ ID NO: 1186 - protein, 114 aa, Artificial Sequence; identical to SEQ ID NO: 216
  Description of Artificial Sequence: Synthetic polypeptide
  N1D/D61N/E64Q/Q108E

SEQ ID NO: 1187 - protein, 114 aa, Artificial Sequence; identical to SEQ ID NO: 217
  Description of Artificial Sequence: Synthetic polypeptide
  N4D/D61N/E64Q/Q108E

SEQ ID NO: 1188 - protein, 114 aa, Artificial Sequence; identical to SEQ ID NO: 218
  Description of Artificial Sequence: Synthetic polypeptide
  N1D/N65D

SEQ ID NO: 1189 - protein, 114 aa, Artificial Sequence; identical to SEQ ID NO: 219
  Description of Artificial Sequence: Synthetic polypeptide
  N1D/Q108E

SEQ ID NO: 1190 - protein, 114 aa, Artificial Sequence; identical to SEQ ID NO: 220
  Description of Artificial Sequence: Synthetic polypeptide
  N4D/N65D

SEQ ID NO: 1191 - protein, 114 aa, Artificial Sequence; identical to SEQ ID NO: 221
  Description of Artificial Sequence: Synthetic polypeptide
  D30N/N65D

SEQ ID NO: 1192 - protein, 114 aa, Artificial Sequence; identical to SEQ ID NO: 222
  Description of Artificial Sequence: Synthetic polypeptide
  D30N/Q108E

SEQ ID NO: 1193 - protein, 114 aa, Artificial Sequence; identical to SEQ ID NO: 223
  Description of Artificial Sequence: Synthetic polypeptide
  N65D/Q108E

SEQ ID NO: 1194 - protein, 114 aa, Artificial Sequence; identical to SEQ ID NO: 224
  Description of Artificial Sequence: Synthetic polypeptide
  E64Q/N65D

SEQ ID NO: 1195 - protein, 114 aa, Artificial Sequence; identical to SEQ ID NO: 225
  Description of Artificial Sequence: Synthetic polypeptide
  N1D/N4D/N65D

SEQ ID NO: 1196 - protein, 114 aa, Artificial Sequence; identical to SEQ ID NO: 226
  Description of Artificial Sequence: Synthetic polypeptide
  D30N/E64Q/N65D

SEQ ID NO: 1197 - protein, 114 aa, Artificial Sequence; identical to SEQ ID NO: 227
  Description of Artificial Sequence: Synthetic polypeptide
  N4D/D61N/N65D

SEQ ID NO: 1198 - protein, 6 aa, Artificial Sequence
  Description of Artificial Sequence: Synthetic 6xHis tag
HHHHHH

SEQ ID NO: 1199 - protein, 10 aa, Artificial Sequence
  Description of Artificial Sequence: Synthetic peptide
  MISC_FEATURE (1)..(10): This sequence may encompass 0-5 "Gly Ser" repeats
GSGSGSGSGS

SEQ ID NO: 1200 - protein, 25 aa, Artificial Sequence
  Description of Artificial Sequence: Synthetic peptide
  MISC_FEATURE (1)..(25): This sequence may encompass 0-5 "Gly Ser Gly Gly Ser" repeats
GSGGSGSGGSGSGGSGSGGSGSGGS

SEQ ID NO: 1201 - protein, 20 aa, Artificial Sequence
  Description of Artificial Sequence: Synthetic peptide
  MISC_FEATURE (1)..(20): This sequence may encompass 0-5 "Gly Gly Gly Ser" repeats
GGGSGGGSGGGSGGGSGGGS

SEQ ID NO: 1202 - protein, 20 aa, Artificial Sequence
  Description of Artificial Sequence: Synthetic peptide
GKPGSGKPGSGKPGSGKPGS

SEQ ID NO: 1203 - protein, 25 aa, Artificial Sequence
  Description of Artificial Sequence: Synthetic peptide
  MISC_FEATURE (1)..(25): This sequence may encompass 0-5 "Gly Gly Gly Gly Ser" repeats
GGGGSGGGGSGGGGSGGGGSGGGGS

SEQ ID NO: 1204 - protein, 5 aa, Artificial Sequence
  Description of Artificial Sequence: Synthetic peptide
EPKSS

What is claimed is:

1. A heterodimeric protein comprising:
   a) a first monomer comprising SEQ ID NO:1014; and
   b) a second monomer comprising SEQ ID NO:1017.

2. A nucleic acid composition comprising:
   a) a first nucleic acid sequence encoding SEQ ID NO:1014; and
   b) a second nucleic acid sequence encoding SEQ ID NO:1017.

3. An expression vector composition comprising:
   a) a first expression vector comprising a first nucleic acid sequence encoding SEQ ID NO:1014; and
   b) a second expression vector comprising a second nucleic acid sequence encoding SEQ ID NO:1017.

4. An expression vector composition comprising an expression vector comprising a first nucleic acid sequence encoding SEQ ID NO:1014; and a second nucleic acid sequence encoding SEQ ID NO:1017.

5. A host cell comprising the expression vector composition of claim 3 or 4.

6. A method of producing a heterodimeric protein comprising culturing the host cell of claim 5 under suitable conditions wherein said heterodimeric protein is expressed, and recovering said protein.

* * * * *